United States Patent 12,790,634 (MOST PROBABLE NUMBER ANALYSIS OF HETEROGENOUS POPULATIONS) - sequence listing, part 12

SEQ ID NO: 6 - DNA, 6163161 bp, Blautia coccoides (residues 4,108,775-6,163,161 of 6,163,161)
  source 1..6163161: mol_type = genomic DNA
tttcgattccaaaaccacgatagcctggcggatctgctcatccagccggtatctttcaaatcttgagaaaagcgtctggttgtctatttttgccagtaataatatattgctggtaagttttgaaaggcgcattgtattaaataggattttattgacatactctgcctgctcttttgaaaactggggattgtcctgcagcagcatggcatatccctcgatagcattgatgggagttttaaattcatgggatacattggatataaaatccatctgcagcatctctgtggattccagttcttttaccatttggttgaagttactgtacagatcctgtatctcgtctatcttgctttctgtctcaagctttaggttaaaatctccttccgccacctttcccattttctgattcagcttctcgatgggggaaagtatgatcttactgagaagagacgccagaataccgcccaccaggatactgagcagaatctgagctgttgtctccggtaaagcagttgaagattcaaaaactttgttcagaaacattataatgaccaaagacagaatatatgcactgataagaatacctaatatgatgaacataaaatatctgcgcatattgatccttgattttttgcctttgaatattttcatttcttcatcaccttatatcccacaccgcggagcgtaatgatctgaaaatcagggttatctctaaaacgctcccgaagtcttgcaatatgtacatctactgtatgagtatctgtatccgcataatatccccatatctcatccatgatctgctgtctggtgaaaatacgtcccggaaaagagaccattttatacagcagcatgaattccttctgcggaagaacataagattttccatcggtaataactgtcatagaatcgtaattcagttctgtactgcctatgacctgcctgcggctgctggccatttgagcacgccgcagcaacgcgcctactctcaacaccatttcatttacgttgacgggctttaccatatagtcatctgttccggacaggaatcccagcttcatgtcatcaaaggcatccttggctgtgatcatcagaaccgggttctgatatccggcgtcacgaagggcctgtaccagctcatatccatccattaccggcatcatgatatccgaaatgatcaaatccacatattcctgctccatggcatccagagcttcacgtccattggcaacacctttgacggaatatccgtttttcaccagtaccctctggaaaagctggcggagttctgtgtcatcttctacgatcaatattctgaacatgcttacctcccataactttatagtctcttaatatgctactctctctgcatcaatattctctcaactcagcatcaacatttgttgacaaacagtaaagatgcctaaattaaatgttattgtacctcatagtatttcataaatcaatgggatcctcccatttctttttgtctgccatctgacgcgtggcttcctcgggattgccctgcaaatgcaaggcatcacctggcgggacaacggaaggctttactgttacttacagtcttctcagaagtaaaaatctcttgacaaatccgcatacacgctgtataacaagagttatataacattcgtaatattagaggtaagaaaatgccaaaacaaaagatcacaaaagaaatgatactggatgcagcctttacactgctgcgcacaaagggacatgaagccgtaaatgccagaagcattgccagtcaggccggctgttccgttcagcccatatacagttgctattctaatatgccggagctgatggaggaactgtttgtctacacccagcagtatctgacagaatatgtggaaaagaacgctgacaaaaattattattttgcgtccatcggacggtgccatattggatttgccagggaagaaaggtatctgttctgtttcctgttcttatccaggtatatgaatatcaacagcctggaagatatatacagacagtgtgccaggcaggatgtcaccagggatatcatgagaacactttctatcagcgaaactgccgccaagcggctctacctgcatatgatgctgtacacacacggcattgcctccatgatagccaccaaagccgcccacatcccaaacgaggagatccgggttctcaccgattccgcattccatgcatttctcaaccaaataaggacggaggaacagtctaaatgaaattaattatccacgatttgacagaagatacactgcagaaggtttatccgaagattgcccccaacgatatggtcattacggacagcggcagcatacgcccctgtatcggctgtttcggatgctggctaaaaacaccgggggcctgtatcctcaaagacacctatgaacagatgggaaaaaacattgccatgtgcagtgaaatgctgatcatcagtaaatgtgcttatggcagctacagcccctttgtaaaaaacgtgctggacagaagcatctcctatatccatccctactttacggtcaaaaacggggaaatgcatcaccagcagcgctataaaagggacttccggttaaaagtcgttttctatggcaatggcataaccgccaaggaaaaggaaaccgcgcaaaaattggtaaaggcaaatgcagtcaatctttactgtaccgtggaatctgtcacctttctggattccattcaagaaatggaggcactgaaaatatgaaaattgccctgataaacggaagccctaagaggaaagacagtgcttccggccttatattaaaagaactgcaggggcttatcccctctgaaaatgagatcataaaccttcactttacaaaaaaacagcccggcagcagtgatttggaactcctgcaggactgcagtataatggtctttgcatttcccctttatgttgattctcttccctcacatctgttgtcatgtctggtccgattagaggaatatcttaaacacgctgccttttcaaaggactgtactgtttatgctattgcaaactgcggattttatgagggaagtcagaatgcccttgctctggatatcatggaaaattggtgctccaaagccggagtcatctggggcggcggtcttgggatcggcgccggaggaatgatgcctgtaataagcggtatggctgccggaaagggacccaagaagaacttttccggtgcattcaacacactgtctgacaggatactgcgtcaggaaaccggagaaaacatctgcttctcacctaattttccacgctttctttataaaatggcaggtgagatgggctggcggcaggcagtaaaaaacaatggtctgacccgccgggatctgtggaacaaacaagtctgaatccacatctttttactataaacaaaaacgggaaaccggcagaaaaatccatgccggtttctctcagtctctcaatatttttcccatggcttttcccttggcaagttcgtcgatcaacttatccaaatatcggatctcctgcatgagcggctcttcaatatcctccaccttgatcccgcatatctttccttttatttgttttctgttgggattcatcttcggtgcattcccaaagaaatctgcataggatatggtcttttcagccattgaccggatctcatttttattgtatcccgtaagccagcagatgatatcatctacctcttcctgctgccgcccctttttcagcgccttattgaccaggagcggataaatttttgaaaagctcatctgatatactttatcatgattcattggtctgtcctccacattttaaacacactcgaaaacttaatctccattgactttatgatttcctgaattgtaactgctcagtaccttcacagttactttattgattctttcatacctggcagatgacagccgtttctgcacgccggatctgtaataagatcagcccctgtcagtccagatggaacataggtttcagatccactgaaacagggctgttgtcagggtttgtctccataatatccgccatatgatcccaccatttccggttgaccgccgtgtcagccccttttgcccacagctcctcattttcaatctctatacagccgaataaggtcagtgtctcccggtccagaaagatagagtaattctttcctccatgggcatggatcatctccttcatctcaggccaaagctcattgtgtcgcctttcatattctgcctcacagcccggatataatttcattttaaatgccttgtacatatttttcctcctgatcatcaatgatatccgtaatactttcttatgctttacattatacttttattttacgccaaaagctagacccatctggttccacaccacttagacaggataaactgctgctgccgattttaattttgatattatttccaaatccccttgacatttatctactataattgtagaatatacttaacaactacatttgtagaattttatatttccatacaatacatataagatgtcacaaaagaaaaactatagtcatgtctgcttttcaagggggttttgtgtatgcaggaatttattatcaatatactccgaataaatattatggcggcgttctgtattcttatcaccgcagtcaccgccaggtttttaggccataaatattccgcccggtggaaatgtgccatatggctgcttttatccattgcactgctgttccctataaatctaaccgggcatacctcactggtgcagatggaagttccgcttccgcagctgcacgacactgccttttctaactggaaaaatgatgatcctgaaactgcctctgccggcagcgctgttatgaatgaagggatttctgctgccgatggcactgatatcaacgggaatactgcttatgcccatggaactaatatcggcggaaatacggccaatgccgatactgcatctcacattcagtcatcaaagcagacctttgcgtaccaatccgcatattcacagcagcagagttcgcagattttcgccagtatcaaggcactggatcttgaccggatcattgtctttatatggctgaccggagcactgcttctttttacttttcatgcttttaattatgccaatgccctccgtaaactgagacgctggagttctcccatgctggatgagatcacgctggacctctaccgttccagatgtaaactgcttaaagttgacaaaaaaccacgtcttttaaaaagcagtgatctgtccacacctttgctggcgggatttctggatacctgtctgtatctgccagatcaggattactctccccaggagctggattttatcttccggcacgagttatgtcattatcagcgcagagacctgtggttcaaagggcttttatttgtggtacgcagtctgtactggtttaacccgtctcttttatatatgcagagagaagctgagaaggatctggaattcacctgtgacgaacatgtgatccgggactttcctcaaacctcccgccttcgatacaatgaactgcttctgagaacagccgcccattctgacaaaaagctttcccgcctgactgccgggctgaatgacagtctctctggttttaaagaaagagtacacaatgtaatggatgccggaaaacggaaaaaaggccgtattcccgccctgttccttgtgctgatcttcttaagctctgtgctttttatcggctgttccctgaaaaccggtgatacgtcttccgaaaatccatctgccgcagagcaggaccggccggacgaagcatctgctgcttccggcagcgccaaaaaagaaaacacaatttcccaggacaaatctgcagaaaaagaggaaaacctctccgaaacgaaaaacgagccgataaaaacagctttgaaaacagatacccccgaaaatcaggattctaaagacacagacctgaataatacgaatcttaaagacacgaatcctaaaaatacagagcctgaaagtgcagcgcctgaaaatacggagcctgaagcagaattaaatccggaagaatttgtgatatttgacagcggcacaaaagtgcttacccagcaggacacagccaatctttccacggaagaactgatgtatgccaggaacgaaatctatgcccgccacggttatatttttactgaccctgatatcaaaagctattttgaaaggaaatcctggtatagaccgaaatataccaaagagcagttttctgatacactttttaatacaacagaagtacaaaatatacagttcctgctgtcacaggaaaatgccggagatggactggctctttatcagggggatggatattcttttgaatatccggcagattggcaggataaacttgtttttgagccaacccaagttggagtcgcaggtgttttaaaggaacagtatgaactgcgccagagcggccagtctgacctttacggagatgtttttactatatcaaagcatgaaactaatgaccttcctgatgaccttcagtatctcggacaaggtcctgacggaatgtattattacttttatatagcacagggcgtcactcacgaagaaacaccggagatgaatgacgcatacagcagactggatttttccctggaaagagcgcaggtcattccagacaccttcaacttcaactgactggtatgccactataaacccaacaggctccgctgtctgtatcaaacatatctaggatcatttaagccccgcctgatgacagcggaagtgagaatatataccgcacactctcacttccggctgccacaaggcggggcatctctttatactgcctacgcagattcctccgcaaaatttcctgtatacaactggtaatactttcctttttcctccatgagctggtcatgagttccacgctcaatgatacgcccctgttccaggaccataatgcagtccgaattccgtaccgttgacagcctgtgggcaatgacaaaggtagtccttcccttcatcagccggtccatgccctgctgtaccagtgtctctgtcctggtatcaatggaggatgttgcctcatccaggatcaggaccggcgggtcagctacagcagcccttgcaatggccagaagctgcctctgtccctgacttaaattagaaccgtctccggtaagcatagtgtcatatccatccggcaggcggcggataaatccatctgcatttgccagctttgccgctgccctgcactcctcatccgaagcgttcagcctgccgtaacggatattctccataacggttcccgtgaatagatgggtatcctgaagcaccatgcccagagaacggcgcagatctgatttcctgatcttattgatattgatattgtcatatcttattttgccgtcctggatatcatagaaacggttgatcagattggtgatggtagtcttacccgcaccggtacttcccacaaacgcgatcttctgtcccggtgtggcaaataattttatattgtgaagcacgatcttatcatcattatacccgaaatccacatcgttgaaagtgacatctccctcaagtctctgataggtgactgtcccctccgctttatggggatgtctccaagcccacacaccggttctttcttcgctttccgcaaggctgccgtccggctgttcttttgcgttgaccagttccacatagccattgtccacctcaggctccgcgtccagaagcttgaagacacggtccgcaccggccattgccataacaatgctgttcatctgctgactgatctgtgtcacgggctgagtgaagttcttgttcagtgtcaggaaggataccagagttcccagcgtcagccctccgaatccctttaaggccagaaccgcccccagcacagcacagagcacataactgatatttcccaggttgccgttcaccggcatcatgatattggcaaaggtattggccttatcggcactgtcacgaagctcctcgttcagctttctgaagtccttcacactcttctcttcgtggcagaacacctttactaccttttgtccctccatcatttcttcaatataaccatttacccggcccagatttttctgctgttctccaaagtacctgccggattttccgcttaactgtttcgtggtgatcatcataatgccgatcattaccagtgtcaaaagcgtcagaggaatatccagcacgatcatgctcacaaatgtgatcacaatggtcaccgctgaatttacaacctggggaatgctctggctgatcaactggcggagggtatccacatcgtttgtatagacagacataatgtccccatgggcatgggtgtcaaaaaacttaatgggcagggattccatgtgggtaaacagatccacacgcagatatctgagcgttccctggctgatgtacaccatgatcctgttataggcaaaggcacataaaacaccgactgcataaattccgatcagcatgagcaatgcatttttgagcggcccgaaatccggatcagacatttttgtcatagggataatatagtcatcgatcaatttctgcataaacagggtcccggacagggtagccagtgccgtagccacaatgcagactactaccacggcaaaaagccctttataattcttcatcatatatccaagtgtccgtttcaggactttccccgcattatccacttttggtcttggcccatgcgcgttcatgcccgggccttttacagcttttacattttctgccattatgctgcacctcctgtcttatttccggcctggtcaaaatcaccgccgcccctgatctgtgtatcgtaaatttctttgtaaattttattattagccagcagattcgtatgtgtgtcaaatccgttcactctgccctcatccagcaccagaatcctgtctgcgtcctgtacactggaaatcctctgggcaatgataagcttagtggttcccggaatagcttttgtaaacgcatttctgatcttcgcatctgtggcagtatcaaccgcgctggtggagtcatccaggatcaatatcttgggatttttaagcagtgcccttgcaatacagagcctctgtttctgccccccggatacgttggttcccccctgctcaatatacgtatcatatttgtctggaaactgttcgataaattcatctgcgcaggcctgacgacacgcctctatgcattcctccctgtcagcctgttcatttccccatcttaagttatccagaatggttcctgaaaagagtacattcttctgaagcaccacggcaacctggtttctcagttcctccatgtcatagtttctcacatccttgccgcctacggatacagagcctcccgtcacatcgtacagacggcttatgagattcacaagacttgattttccgcatcccgttccgcctatgatgcctatggtctccccggctttgatgtgcagatcaatgtctgtcagcgtctccttgccgctgccgtgtttataggaaaaattcacgtggtcaaagtcaatcctgccgtccggtatcactttatccggattctccggattgaccagatctgctttgtcgttcagaacctcggcaatacgtctgccgcttgccgcactcatggtcaccatgacgaatatcatggacagcatcatcaaagacatgaggattcccataatgtagctgaacatggaagtcagctcacctgtggtcagatctcccacaacgatgaattttgctccgaaccaggaaagggcaacaacgcagaaatagatgacaaacatcatcacagggccgttcagggagagaaacttctctgccttcacaaaaagactgtacagattgtttgccgctttggtgaatttctcattctcatgatcttcccgcacataggctttgaccactcggatagcggaaacattttcctggacactggcatttaattcatcatactttttaaacaccacatcaaatatttttgtcgtcctgctcataacaaatatcaggacagcagccagaactacgatagccaccacgaaaataaggctcagcttcacgttgataaaaaagcacataaacatactgcagatcagagtaaacggagcacggaccgcgatccttaagatcatctggtatgcattctgtacatttgtcacatctgtggtcatacgggtcaccagacccgcggtactgtatttgtcaatgttggaaaaagaaaatgtctgtatattgtcatacatcgcttccctcagattacacgccagtcctgaggaagcactggctgcatagcgacctgccagaactccgaaaagcaggctgagcatggcaaataccagcatcagggcaccgtactggtacaccttggaaatgctgccggcctcaattcccttatcaatgatcgccgccgtgataaatgggatcagaacctccatcaccacctccagggcagcatataggggtgtcagcagggaagcctttttatactgcttcacctgcgcaagtaatgtcttgatcatattgtaagcctcctgttcattctacgatagaaaccgcgcactgcgaaccttccattcacggaatctcattgtttcagattactcagcatccttcccaaaagttctgacaaaagaagcttttctccctctgtaaacccctgatacatacagccttccagatttttaaagccctgctctatctcatccttcagctcatctgcccgttccgtaagacagatatgcttcagccgttcatccgatgggtccggcatgaaatctatatagcctccgttcttcagttttttcagaagagatgacacattggctttggaaagccccagggatatatgaaggtctctggcgcatatgttctgttcctcatggtccgtcagatatcccagcacattacactgggcagcggacatgccgtgtttcaccatcatggcattgcccagggactccatggccagattcagctttttcagcagacgcatcacattttcatcttttacattctgcatatttcatctccttatctgaaacaagttcgcttgctgactgtttccttacaaactagttttacaccatttttccttgtatgtgaattagaaaaatgttatcattgataaagaacattaattaatatcactgatttatttttataaaaaggagtttctatgaataccgtacagttggaatgttatatggcagtggctgagaatctgagctttgcccgggctgcggaacagcttcatatcacccagcccgccgttacccatcagatcaattccctggaagccgaattggatgtcaagctgttcaaacgcaccaccagaacggtggagctgaccgcccagggatgggtcttcttcggctatgccaaggatattctggccaagacagcccaggcgaaaaacagactggcgggacattttgaagaccagatgcagccttttgtcataggatgccacagcccctttgagctgacactgctgccggaggtactgcggatgctggtcgagtcctatccccaggtgcaccctgatattaaaatggtgcctttccaggctctgcgcaatcttctgcaggaggaaactttagatgtgatgctgggattcggtgaggaaaaagaaaagaaaaagacaggcacttatgtggaactgaccaaagcgcctgtcgtatgtgtgactgccccggatcaccctctgtcctccaaaagcgcagtcacttttgaggaactgtatgaaggccgcctggttctgtgtgatccccataagtcccctcctgtgatcacagaaatgcagggaaagctcatcagcacacgtccgccctcccggatgttcttctgtgaaaatattgaatgcgctcttgcttttgtaaaagcaggcctggggtttaccattttgccggatatgcctctcatgaaggacagcagcctgcgctatatacccgtaaaaaatgcagcaccggcatcctttgggctttattacaaaaccctccagaataatccggtgctgcgcagttttatacatattatgaaagaatattcacagccgcagatataacatggctgtaaacatcctttcatacaacattacttcgagctttacgatggactagagttgcagatcgcgggaatgatttttcaaacaggctttagcccaaatctcctgccgcctttatctttacccggtttgtattgcctgggtagtaggcaaggggaacatcctccatatcaatgatctccacggtctcctctatggctccggcctccacagccatggctatggcctcttttctggcctgagccagggcatcctctctgggaaccacgtcaaagtccaaaagcttttcataagttccgctcaccttggagatggcagaaccgatggcgttggctgtctgggcatgttccgggaccacgctgcggctggttccctcaagctccttgggaaggataagggaacctcctcctaccatgatgacctccacgtcctgactggaaaccttcatggcgtcaatgccttcctccaccattgcctttataacatccatgacccgctttgcaaaatccgggtctatatgagagaccttctctctgtctccgatctgtgccattcccagacggacagcaatgtctgtggcagtcatcacatcaccgccgaacaccagggctttctccgtgatgcggtatcctacactgtcaggccccaccgtcactgtgccgtcctctttctgatgaacaatagaaccgcctccaagaccgatggaaaatacgtccggcatacggaaattggtgcgcacaccgccgatggtgacggcaacactggattcccgaggaaatccgttctggataacgcccagatccgtggtggtgcctcccacatcgatgaccaccgcgttctgtattctgctcagatagctggctccccggatcgagttggtaggtccgcaggccacagtgaggatcggatacttctttgcgtattccatggtcatcaaggtgccatcgttctgtgacaggtacagcgctgcattagtaacgccttcctctttcagacttttggcaaatccatcggtaaaccgctccgcgactctgcacagagccgcgtttaaaatagtggcattttccctctcgatcaatcccatagatccaatctcactggatatggagatccgcacatccggtcccaggatctctctgcaaagctgtgctgcccgcagctcatggtcattgcgcactgtggagaacacacaggaaatggcaacggattccacctttcctttgatctcccggaaaaattccgctgctgcctcctcatcaaaaggagccagttcttttccgtcatactcaaaaccaccgccgatcacagccacggcctttgctgcggccctgatatcctccgcccagtccaccatgggaggtatcccaagggcagccggcgctccgatgcgcagaatgccaatgtccgccagttgttttctctccacaatggcattggtacactgggtagtgcccagcatagccatggaaatctcctctttatttacaccggagacctgtaaaacttcacgcacggcacatacgatgccgtcatagatatcctctgaagtgggatgcttaatctctgccatcacctctaaatgttcattgatcaggaccgcgtccgtattggttcctcctacgtcaattcccagcttatacatctgtacgtcctcctttgcagcgttcttccagcggaatataatccgtatcacagccaaaataccgtggtcccaccagatccagtcctgcctggcttctccacatctcaaagcatttcagccccaccagcatgatcctcttgccgtatttgagagcatccgtggtgaccggaacaaaggtttccgtatccacaagacagataagatccggcacagtggctaaaatttctccatccaccactgcggtcagattttcattctgaaattccacataggcctgtcttcctttatattccccaatgccctccagacatacttttccgaaattaaatgcccctctggtctcccggagcacatcaccgatttttcctttaaagagcttaaatccctctgaaagcttcaggaaattttcttccggtgttccctcctccatctctttgacactgcggatcacttgacccagcttctggctcctggtgacaatatttttcacagcgtattttttcagctccgcaccgctcatacagtacagcgccacagaaacagagccgccgcagctcatagtcactgatctggccagttcttctgtccatttattagttatggtgttgaatatggcggaattgcccttctcatctgtgagagccatagggcttgcgctcatgccgcccatggtaaatgtcaccatctgcaattcaggaaaggcccgccccatgccatccgcgtccaccatgggaagtcctatcctggcagatgccgcgatggggagcatactgttcacaccgcccgcctcaatgggcataaaggcatagacctcttttccaaaaaacttggagaccatgtcatagagcacccggtactcatttcctccgattcccttctcccccaaaatcgtaggcgcgcccatcatggcgataggcactataagcgcatcatccggcacttcctccgggtccagaagtgtgaccggaccgcattccctgacagctcccatagccaccagcttgccaatataagggtctccgcccccacccgcacccaaaagggcagctcccaaggcgatatcttcaatttcttctaatcctatcttcctcaaaatcccatctcccatccagcggctcagagtctgtctgagacttcttgaccgcgcattttgtttttttctattataaacgctttttctgccgctgtaattatggattgggttaaactttttcactgtcttttgtccttttggacaaagctgagtctctgaacaggcggagaacagccgcggcttcatagagacgcccggcctccggcattttttgtatcctgtatcggaaaaactcatggagctttcccacccggtatttgatcgtgtttttatgtacatacagaagctctgcggtgcgggcaatattgctgtccgcgtccaaaaggaaggtttccagggtcttgtacagctcttgatcctgctccttcagccctttgagacaggctgtcttttccaggatcgctttttcccctgcttccagggtttgtctgcaggcatctgcaaactccagttcacttcccgtcagaatatggcggcagggatagatacatctggcctcctccgcgtattccgtacagaggagaaaggcgctgcgcacctgtgccgtattttcaagtcccggacagcttatgaaaaggatatctttatccgcctcctcatagaatccctccaggatctgttcctgttccgtttttgtgcgttcccggccggtaaagacaactcccagcccctgatggatgcccgatatgcagatatcgtaatactgctccagaaatgtactggcgtgcctcacctctttttccaggcttctgttctccttctgtccgtttctttttcccggcagcagaaggagcatgtgatgaatggatgttacatcgatccggaagatttccgcaagcctgcgcattttcaccggttcgtcatttaagattgccttcaaaagctccccgattcccacattgccgtatcccctgctccagacaccgatgaacagccttaccgcctcagcggcctgcagacagagctgggcatggagcttttggtcctcacggacaagaaacagggtaagtcccgcattgtcagcgtccctaaccggcgcgcagaacacccagcgcccggagggaagacgttccatctcctttgacgactccggagcctccccgtggtaaaactgctccagttcctccagggaggattttcccgcctggggccacacggccagattcacaggacggaagctgccgtcaaccagaaaaagggaacagcgcagcctgtcactcagcatcctgaccacagcctccacggttctctggctctcgggaaggtagccgaaccgctccagcatctcccccaccagataggtatcccgcttctgctcactgattatggcatgcataacctctgtgatcacctcactgtagcgcaggtccatacggttttcaggcatacagataaggacaaagcccaattcatccgcaagggatatgacttccggggcaatgctctttaaaaagattcccacatagtacaggatcagacccacttccccgccctcatagagtctgcgtatggtggcaagctgcaggggcacatcctcccttgcattgataaatcccgttatggtaatctcccctccgtaaaaatcaccggggaacagatcgtcgtttaacatctggggatccgcatattccagaacagatatggatgtgactacttttttaagccctgatctccccgctgccacccaggcgtctccaagggagggaagcttcagcagatcttcaactgtaatactcatcttatctcactcctctctgcttcaaggcacttctgcatatccccgggaagcggcgcctgtacccgtatcttctctcctgtaaagggctgaaaaagggtgacacaaaatgcgtgcagggcagcccgcctgattttctccatgctgcctccgtacagactatcccccaaaagaggatgaccgatccatgccatatgcacccggatctgatgcgtcctccctgaagaaagactgagctttaccagggaactattctccattcttttaagaacctgatacctggttacagcagttttaccctggggggacacacacatcttcatcagttccccctgcattttgtctatcttcccccggatgatcccctcatctttttcgggacagccctccacgacagccaggtattctttcctgaatttcccctgctgtttctgttctgccagtcttcccgctgcagcctgattcttggcaaaaaccacaatacctgaggtgtccttatcaagccgccctatactccggatcctgacatgctcccctctcttttgaaaataataggccagcatattggataaggaatccgtgtaatgcccgtgggaagggtgcaccaccagacctgatggtttgtttacacaaagcagatcttcatcctcgtataaaatatccagttttccctgtgtcggcacaagttgcggggaggcagtgtgctgctcctccagttttacatccaccctctctcccgctttcaaggcatatatgatcctcgctttcacgccgcccacacagattccgttctccctgaactttgcctgttttatctgccgttttgtaagacccatatcgtgaagcagaaagtctgaaagcgtacagtcccttcctgctgttttactccatatcttttccatatcctcatccctgtgcgtgttctgattcttccttttctatcttttttcattctaacagagtccgccaaatgcgtaaagaaaataaaagaaaacctctttcagaacccttcttcccgtgatagaatggggttatatcaatccgggcataaagggggatatattatgcagatcagcagcctacacataaagaattttaaatacatacgggacatggaaatccgtgacatcgaaaacgccctgatcctggtggggaaaaacaatacaggaaaaacctccgtgctggatgctgtgcgtgcggtgaacggttcttaccaggtgcgagaaagtgacttcaatgaaaaaaagcagcgaatcgagatctccatgaccttgtccatctccagggaagacctgcagatgctgcaccaccatgggcgtgtgagtgtctaccgaagatataccgcctggtatgaggatttctgcaaaaagctgccctcctaccagaacggaagcctgacctttacctacaccgtcaatgtacttgggcaggaacgattgagcgatggtcacgaaaagcacaacaagtatatccggcaggtgcttccgcagatttactacatcggaacggacagacggctggaacatcttcagaaggacctgctggcctttgaggaggatgaacagttaaagagaatgcgctccgacgtctgcctgtttgagagcagcaagcactgcagccgctgcttccagtgcatcggcctgatcgatcagaaacgccctgaagagctgactgcctttgagaccgctaaactgctggaatacaagctctgccagatgaacttgacagattttgccagacaagttaatgccagcttccaccgaaacggcggttttgatgagatccgctataccatgcgctgcaacattgacgaaatgtgttccgtaaccgcagaagcttacaacaccaaacgccgtaccgcaaccccggtggaacacatgggagaaggcatgcgcagtatctatatgctctctcttctggaggcctacacccaggacaacaaccggatccccagcgtcattctggtcaaagaccctgagaccttcctccatccggagctgcagaaaaaggcaggagaaattctgtaccggctgtccaaaaagaatcagattttgttttccacccattccccggatatgatcttcaatttcagcagccaccagatacggcaggtagttctggatgagcaatactataccattttacgggaacggacagatatgaaccgtattttagacgatctgggcttcaacgccagtgaccttttgaatgtaagctttgtctttattgtggagggtaagcaggataagagccgccttcctctgctcctgaggaaatactactcggaaatcacagctccggacggcagccttttccggatcgccattatcaccaccaacagttgcaccaacatcaaaacttacgccaacttaaagtacatgaaccagatctatctgcgtgaccagtttttgatgatccgggacggggacggcaaaagcagaaccgaactggcttcacagctctgccgctactatgaggcaaggaatttggaagatgtggaccatctccccagagttgccccgagaaatgtgctgatcttgaaatactattcctttgaaaactattttctgaatcctgcagttatggtacagatcggggtattggagaaagtagaggatttctacaggatcctcctggaaaagtggaaggcatatctctataaactcaggagcggacgccatctgacagagattctgggttttgaaatccagaccgaggaagacctcaaaaaccatatggaagaatttaagatttatatgcggggccacaatctgtttgatatcttctacggtccctataaagcagaggagcaggaactcctaaagcgttatatcgacctggctcccagggaggatttcagagatatcctggacgcggttgaccatttcatctattttgacagcagaaaaaaacagtaaaccagaataccggagtctgtgaccgccatccggtcaggacaccgtgcccggtatgaaaagggggcagccgcacgaaacaacgtgcgtctgccccttatttatgtctcttccatctcaggaacatagacggcatacccgccttttccgctcctttttgctttataaagagcaatatcagctctgcggtacagctcttggaaattctcactgccttctgtcatcaccgctcccatactgccgtgcaccgggtagtcctctttttcacctgtatagagggtttcccatttctttacaattgcgtccaggatcatggttagctgctgattcctctgaacattaatgagaaacaccataaattcatccccgccgatcctgcccacaatatccgtagagcggaatgtccggtgcagaacatccgcaaagcggacaatcgcccggtctccctgggcatgtccaagtgtatcattgatccgtttcaggttgtccatatccacaacgagaagcgcgcagacactgcccctgtattttctgagggcatgggtgatcagttcctctgtggccattttattatagagtcctgtcatggaatctgtctcggcacgcagtctgagagcctctttttccctcatactttcatcaatattcatcatctttcccagaatacgcacgactcttcccctgtcatccgcaaaaatactggtaaggagtgaaaaccagatatagacaccggcagaattgcagaaacgtatattccgggtcataacaccctttttgctgctggactggggcagtatcctggaaaacgaggtcacatcatcaggatatacccatttcccgtctaaaaaagactggtaatccggttttatacccagtatcttttcaaagttttcattgaattccagtgtgtgttccagataattgatctcgaataccagcacatccgaatctctggctaaaagcctgaatctctcctcagagacctccagcttttctttttcctccataagcttccgagtctgtgcctttaaaatctttctctctgtcctgaagagataaaacaaaagtaaaaagctcagtaaaaaagaagctgcaaatgcaatattcagccttaccgaataggctctcacaaatgaataggaggaatccacctcacttcgcttcatggcagataaaagcgtccacccgttatatccaaacggggtctgggtcacataatactgctgcgatttttcctgaagcagggagaccatttttttcccgtcccgggctgcctgtttcatatcctctacggaatgcccatccagaaaagcttccttctgtgtcttctcaaatacattctcctggctcttatcccctaccatgatctgtccgtcttttgacgccactatgacctcacccttcccattgatgagcacactggcatcgttccgcttaaaaatatcatgcagaaacaaggttccgaactgctctgccgtataagatccgcagagcactcccgtaatctctccctggggatttttaatgggaacagccagaagaacacacagatatccgtcttccatactggatataaacggctctgatatggtctgttccccctgcagcgcttccctaaattccttcaagtctttgatattcttctgaataccgtcatcggtcattccattgccatccggatcggccatggtaatgcggtaaaattcctgagtctgcctgatggcattggctgcgctcagaaaggtatctgtgtcctctattcccgcctgtcccagatagcttgcaaaggcgccaagggaattaaactggcctgtaagcacagtccccacataatccgcctgctgctgcgcatagctctccagagttgcgtgaatctctctgctcactcggagatttgtcttctgattataatacatcactaccactgcaagaaaaactgccaatacaacaaacacacacagcgtcagctctgcccgggtatgtttcctttttttcgtcatacatgtaccatactctttcctccgctcatatttccttgtacaactacgcgtattccatatttttcttatgtatttttatctgtcagaagcggttctgttccattttttccattttctcttctgtaagcagaaaaatcttcacctctgcctcgcagtcagccaattcctcctccgtcatttcagttacagcagccacccggctttttccgtctctgatttcccactgcgcgtcctgaaagatcagatcatccccctctgcatctctttctgtatccggcgcagcgcgaagtgtcacagaaaaaggtgatatcccctgctccatattccgcctgtgtatggccgccttctcaagcgtctcctcccgaaaaggatatgcccggaaaagctctgccagatctgtcatggtgacaaaccctctgaaataatagtcattttcctgtaccgcctgctgcagtctcaacctcatgatcatccctcatttccgcccggcatctgtagttctctgtcacgaagcagggcatcgactgctgccctgtattccttcagatgctgtgctttttttattttctttgcgtatttagcgctgtcgggaaacagatgtatcatgtaaaaccagagttctttcattttaaacagtacatttctgtctcctgacataactttctcatattcttcgcagagtatattgtggaatttctcaaacatctctttatccaatacagtatccctggtgatatgtcctataaggtccgggtctgtcaggatccctctgcccagcatcactgcctccacctgggggaacccggccgtaaattttcggtactcttcctttgtaaaaatatccccgttgtagcagaccttgttcctgctcagagacagggcatctgcaaaaacatcaagattcggtttgtttttatagtaatccgtctggagtctcggatggatgatcagctcctccatgagatatctgttgtaaatctctatcagctcgtaaaactcctccggatcctccatcccgatcctggtctttattgaaagtttcatatccagcctgtcaaaaatctcatccagaaattttctcaaaagctgctgttctgccaaaaatcccgcgcctctcattttcgtcacaacagtccgggacggacatcccagattcaggttgacctcatcatatcccatcctttgaagcgcaagggctgtcttcacaaaatcttccgcactgttcgtgagaatctgaggcactgtatacattcccctgttatgctcaggaaggacatcattcagctccctggtattaaaacagcggttctgattcggcatgataaacggggtaaaatatttatctatattattataacatgaatacagggcattgcggtaaatatatccagtaattccctccattggcgccagataaaatttcataatgtgttatctctcccttttatttttctccagccaccgctccagcacttccaggttcaaatctgaatgctccacttccctggcgtagcggtaagctgtctctaccatatcctcaaaccctgtcttctttccattcttcagccatatcagcatgacaaattcctggatccattctgttgaaaaaacagccagagccattttagaatagaccgcgtcgtcatacactgctccgcagaaataggtgtatacaaaaaacaccatgagctgttcccccatacactcccattctccacgtctgctgctttcatatccgtatgtgcgctcaaattccccacacagctccatataatgctcttctccgatttcatagagatcttcccaggcctctgcaagcagaccgccccattcatctctgagctgttccagttcttgaaacacagaaaattcccgttttctcctggtataccggctctcttttttcttctctgccccggatggatgcgggtattttccgatcacttcatctatggcgtaaaattcctcccggcctatacacgcctggaattcctctgccagagaaagcgcctcctgcattctggccctcaaatccttctttctgtctgttagaatttcaaatatcacatcccgggcatcctccaactgggtaaagagaaggaaatcaaagtcttcaaagtcatcttcctcctctgtctcccatgtgataaactccgccttatccctgcacgacaggatcatcctggcagcctccgggcaggagagggtaagggaaagctcccgcagatcctcaaactcctccacatgccgcggatacattctgcaggtagtacagagcccctggggtcccagctctgtataaaggtcgcagagattttcccggttcagaaacgcacatcttttgtcatactgataaaagctctcttccatccaatcaatggaatttctcagtcttctgccgaaatccccctttacatttccatacttctgcagtgattcctcgtcgatcacaatctgccatccggcacagcaggtggccgggcattcgccggcaatacagacaaacttgtcataatagccgggttttacatatctcatattgtatctcctcttactaaagtgtgcagaactcacaccctgtcagcactattacactccttggaccggctgacaggttttggctgtccagacggacaggctgcttttttgtctcagatccggtatccccggtattgacggccatatgccagagcagaggcctgggaagctctggcagcctgacctgaaccggctcccaataggcattcaccaggagatagacaatatcatccttccccttctcctcatcatagcctgcgaacatcaccgccgtaaccctggactcctgcccgaagttctccacccatggattttccctatggaagctgatctccggcagtccgaagcggttgctgcccagattgccgctgatgctcttatgactttttctgaactgtatcataaaccggaaaaattcgtacacatccctgtgggtctcaaatctgctccagtctatccaggaaatttcattgtcctgacaataggcgttattattcccgtactgggtgttgcagaattcatctccggcataaaacataggcgtacctctgctgcacatgagaactgcgcaggcatttttgatcaggcgcatcctaagggtattgacctcccggtcctctgtatctccttccacaccgcagttccaactcctgttgtcatccgagccgtcccggttttcccatccgttggcctcattgtgtttccagttataggaatacagatcatagagggtaaacccgtcatgacaggtcaggaaattaacggaagcgtttttcccgcgtatctctggtctgtaaatatccgtggagccggccatgcgcatagctgccgcctgagctgcccagagtccgccttttaaatattccctcagatcatccctgtactttccgttccactccgaccagcggcagaaggccgggaactgtcctacctgatacagaccgccggcatcccatgcctccgcaataagccttgtactgctcagaagggaatcgtaagccaaagcttccacaagaggcggccgttccatgggggagccgtcttcattccgccccagaatggatgccagatcaaaccggaaaccatcaatatgataatccgaaacccagtatctgagacattcctggatcattctcctcaccaccgggtggttacagttcagtgtattgccgcagccgctgaaattataatattttccgtccggcgtaagcatataatatatattgttgtcaaatcctttaaacgagataaaggggccgtcttcattcccctcggcggtatggttaaacaccacgtccaggatgacttctatcccgttttcatgtagtgcgtgcaccagttctttcagttccaaaccttcccgattgtactcttttgtcgccgcatagctggtgtttggggcaaaaaaagccaccgtattatatccccagtaattgataacctgcctgtcatccacgatcctgcgctcacgcagctcatcaaattcaaagatgggcataagctccaccgcattgacacccaaatccttcagatacgggattttttctttaatacctgcaaacgtcccggggttcttcacatcccctgccatttttgtaaaaccgcggacatgcatttcatagatgatcagttcatccatgggaaccatgggccgccgttcttttccccagaagaaatcgttcctcaccactctggcccggtatcccttttcattcactttttttccccatacgctctggcctgtcactgcctttgcatagggatcaaggagtatgtggttttcatcaaatagaaggccatgttccctgtcccagacccctcccagccggtaagcatactcaaattcaccgatatccagtccgaacaccatcatggagtacacgtcaccgatcttaaaatgctccgggaacctgaggactgcatacggctcctcctctgtcctgtgaaaaagcagcagctcgcagaacgcggcgccctttgaatgcacagtaaaattaacggcagactgaaagactgtggcgccgtaaacgctgtacagaccgggacatacctgaaaccccgccacctcatctgtaggtatccatttttgaagctcatcattcatactgacatccctccctgaatctctctgtcacgataggctgttccctgcaaaagcccgctgccctctgaccggcagctttccctgcatagaagaggaaaaagcccggcagccgccaggcttcacaagccctaaaaacgaaacattttacctgtacgtatctgctgcgttgtctgtgcagtatcaattctgctgcagcacggacagcaattttctcatctgtcccaaacgctcctcaaactgttcatagaaatctttgccgctttcatagggttttgtataaaaaagattcaacacatacatgttcagctcttttgtgagctgttcatcttctttttcttccaaaagattcccgatatctttcagcagaaagtgccatttggcggcaaaatcctcgtattttttcaaatccggcagatccagccatttactcacctttattttagtcttgtttttctttggacattcctgattctgcaggtaataggaaaaatctccgtcccggtaataccttcccagaggaaacaaccggcaaagccccggacgaaaagcatggacagtgcatcttcccttctcattcaagaatgtacagcgctcttttgtacctgacattttcaaattcggcagaatgctgttctctgccgcgtgcagctctatatgactgttcatcaggccttcaaaggtaagccccaggttcgtctccaacctgtacacatccagaggatccagtttaatagaatcccccatcccctgacaacactcaaaacagccctgacagcctccacagtcagccttcaccagatcccctgctttgtataatttctttaagtcctctgccggaacttctctctccatatgtaaatcctctctgttctatatattttctttatggcctgccaaaggccaaaagcctggaaatccctcttgccacccgtccctccgggtcgtcaaaatgcccgcccggatcactctcacggataaccggccacgacttctcccagtaagcggccagacgttccgtgcacgctttcactgtagccatgcggtcattgcgtactttatgctcccttctgccaagcgacacatagatgaccggatttattgccttgatagtatgggacactgcataatcctcccagccgtcaaaccaaagagaacctgacatagtaccgatcctgttgaatttgtcagaatgatacatggcatatacggcaaacaaccccgccatggaatagcccgctatccctctgtctcttacttcaaaggaaagagtctgttctatacggggaaggatatcattttcaaaatacagcaggtattccccggctccccctgaaaaatctgtgctctttgcaaaaaccttctccgccctccatggagaaaagtcgcggttccagtctcttcctgatacccccgcaaggacgcatggctctgtgatctgcccccatattttctccccttcctcccgagaaaaaatatggcaccagattacaggtaccgcttcttttgtctcctctccccaaaggaagatctcaccgttttcttctttccagcttttcatggcagcaaaacctttctgtattacaattgtcatccactacttggataccgggtaactgttcagcggtcttaccatttcagacaaggtaataccatattcgttttaatcaattataaagtaaggggtgcaaaaccgcaatccttttattcaagacggcaatgaagcgcttgcagacagggaaaaatgtagtataatagtgtttggctgttccggtcggaccgtgcccactttagacacaaaagcagtctacacgcagatgatagggagccacacttttgattggtgcagcttatatgaacatttacacgggaggtcgtttgacaatgaatcttatattccgaaaaaatctcaaaaatgcggtggaacgtgtccttcacgttccccataattatacaggcggtattctagaaatgacatttgtggtagatcatggacttccaaaagagatcgcggtgcccatgacaaaggagattgccgctttactccgctctcacagtcaggttttccagaatgtcagactcaacctgctgcactggaaggaggacggattgcttacgaatcaggtagtttcaatctccatgctgcagcttggaagagggctggaggactatgaacccctgcccggaaaaaaatctctggacgctctgaccaacaccctcaagcgttttcatgccaggtcaaagctggtcatctgcctgcttggagcagatgccgtggtattggatgaagagaggataaaagaaaatctgcagccttttctcgggcgaaagagtatctttttatatacgcaggagaacggagcggatgtctgccctgagatcgtgatgggggctgggattctttctaaaataatataagactgcaaaaacagagactgcagtgccgggaattcccctgcgcttcagtctccattttttctgtttcctttgtcactccgttaaattcagcagagcttttttcagttcgggtactgcttctcccacgattctctttatcatttccaaactctgcttatctgaagcctcgatccgatatgtcatagcctgttctgttacagattttctgagcaggaaccatccttcctcaaactcaatacgcacgccatccattctgctcattggataaagatttcccatctttgaggcttcttccagccatctttcttgttcctcataggggcaaaagactctcaagtccgctgtaataatggagtccggaaattcttccgctatttctgccagattccggcgctccttctctactatctcacacattttcagagttgcatatagtccgtcatctctaccgatttccctaaagaaaaaatgtccgctgatttctcctgctgccagagagcccttttctaaaaaacgccgtttaataaaaccgtatccgcttcgctccataaccggtgtccctccataggccagtatggtgttcttcaccagagatgcgcatttctggtcatagacaaaagaacctgtacacttcttcagacaatgtcggataaaaacagcgaaacttttctcactggtcatgtaatgtcccttattatcaataaagacaactctatccccgtctccgtcatatgcggcgcccaaatcagctccggtttccagaacttttttacaaatatcagcaaggcagtcatactctgcaggatttggattcctatttggaaaattcccgtcatttccgcagtaaagccggataacctcatatcccattttctccatgacatccggtactattttgctggcggcgccatcacagcagtccaggactatttttagacttccttttttacaggttctttctataaagtctgtatattcttcctctacacatcttgtttcataaatcccggttccggtgcagaagtcctgccgataaaccagctcttccaacttcttgatttcctctaacgtcattggagcgttcccaaacatcattttaaacccattataactagccggattatgagacgctgtaaccataattcctccctgtggtaccgcagcacaaggatctgctgtgtccagggcgaaataaaacataggcgttgttacacatcctatatcaatcacatgcatgcctgtttccagcagcccccttacaagatactccttcaaaacaggcgtagaaatccgaacatcaccaccgactgccaaagattttcctctgtgcagagtccccactgcttttcctatgagatatgcgtccttctcatcaaattcctttccataaattcctcgtatatcgcaatctttatagatactcatatgttacccctttgctgctcagatatctccaaattgatatctctctttatacaactcaaacgcacgacaataaagctcgtcatatactgcgacaagtctgtgcacgggttcaatagtattacggtaagataccatgtgctctgccgcctccgacagatcatggtaacaggaagccgatgccgccagaatcgcacatcccatagccgctccagtattctcaggcactttcagcatcttatccaacacacttgcccgtatcttcagccattccagtgaattgcaggcaccacctgccgtataaatttcttttcccacacaggcaccgcatttctgcatatgttcaaatgccagacgttcagcaaatgccacaccttccattaatgctgcataatgtacttgtggatcggagatatctccgaggacgaatgcccgggcctttgggtccaaaaaaggaaaacgctcaccgattccgtgcagaggataacagatgaccttagtgggtatcacctccatgactctccggttcctcgtctcaaattcttcttttccaaaaaaatcattcagacatcttccgccgatattagaggcacctccaaacatccagtctccggacggtagtttatgtgaataactgcttccccctgcatcccggagcagttcttctgtgacaccttttagaaccatagttgttcctatgatagatgcccaatcacctcttttgaccgcccctgtagaaattgcagacacatagccgtctgttgctccggcagccaccactgtatcccgtgaaaacccgaattcctctgcaatctcctttgtgacatttcctataacttgccccggtggaatcacagagggaaatattcgcctgtcaagttccagcagatccagcagatttggccatacctcttctttcatatcaaacccgcttttcaaagcattggagtaatccgttaccccatatttccctgtgaatctgcctacgatatagtctgattggtgcaccatgtattttgtctttttatatacctgcggttcctgttcttttatccaaaggattttcggcagggcaaaggatgcgttaaaaacatatcccatcttttttttccaactcaccggcatgttcatgtatcttcactgtctggtctgctgcacgcatgtcattgtacatgagcgcgtcccgcagagggcgcttcttttcatctaaaggtacaatcgttccggaggtgccgtctacagtgacagctcgtatctccaatggctttctatctctctgccacagtatatccatacatttttttatagccagtctgaccgcctcccaccacatagcagggtcctgttcatactgttcttcttttctgcttgtgttcagccacaaaaaatcacacgttccctgtgcaaagaccttcccttgttcatcacatacaatacctctggccccctgggtccccacatctattcccaaaaaaagcattctatcacctttaccctttcaggacttccgggttcatgagaaatctcggcatctctcctgcaaaatatcgttctgcctgtcccaggaccattgcaggactgtcagcaaaagcctccaccgtatccccgcttttatggcagctgaacgtcagattatccaggtcgaaaagcggactgtcctcaggtaccggttccacttcataattatcaatggctgcccctgtgatccaccgttctttcaatgcctcataaagagcatccatatcgaccaaaggtgagcgtgccgtattaataaaaacggctgtttctttcatcatcctgaactgctctcttcccatcatacctcttgaggtacttgaaactcttgcgtgcatagaaacaatatcactgcatccaagcagtttattcagacttaccagttctccacccgcttcctgtacttcagtctcctttacatagggatcatatacaagaagctttacctgaaatgccgctaaaagctttgcgaccgtccttccaattgtaccgaatccgatgatgcctactgttctgcctttcatttcatggattcttccgaagtttggaaagttttccagccattgatgacgcacctgcatggaggcatgacaacggcctatatttctggtttctgcaatcatcagtccaatcgtcatctcagctacagcattcgcattgtgtgccggatttgcaatgactggaactcctgcttttgtggcagcctccagatcgatattctcgatacctcctctgtttgtcagcaatagtttcagattctttgctttttcaaacacctcagagggtataggacactgatgtgtctgtatgacatccgcatctctgatctctctcatgatatcatccggcacaggcacgcagcgtgaacctgtcatctccatgtttttaatatagacccgcatctcttcatgggattttggtccgaaataaaagaattttttctcgtcataacggcaaaagccttccattcccttttccatcatttccggtggaagcagcaaatcgccaatacatacaattttcatacatttcctcctccgtttttcatttctgtctgctttcctgtctctgtatatgtgaatcaaaacatggaagcagacatttttgaagctcacaaaatgtctgatagtttatctcatactctctttgagcgccagagtcaggcagatacgttcgtccaatagtcttcatcttctttacaccttctttcagactggagaacacaccagctgtacagcctgccaccaccacgtctcccatagcagccccttctgtattttcctgtatggttacaggaatccccaggatatcactcagcatctgcatccaggcactgcttttacatggaccgcccgtagcaacaatttcctgaacctcattcggcctcacctcctgagcatccagaacaatatctacgttctgcctgaccgcatagcaggtcccctccattacagctctgagcatctctttttttgtagaagtacctgacaatccaaaaaataccccccttgcattagggttatagattggagacaattcacctgctaaatatggcagaaaaacaatcccatttgccccaataggagcctccgtcacataatcactcatgactgtgaagacatccctatgcagggtcactgcacacagcgtctccatatcacatacagcctctttcatccatttaaaagctccgcctgtgttggacataactcctatattcatcatataatctttatccgcataaccgatcgtaatcaatctggagtctgtcttatattgttctctttccgtacatttctggagcataaccacactgctccctgtcccacaggaataggccatttgatatctgttaaaaatccctgcactcagtgctgccattgccgtatccgaggcacctgctgccaccagggtatgttcagacagccccagttcttctgcagactcttttgttatacacccaatcgcctcgtgacagtcgcagacctccggaaactgtctcaaattgatctgcagtttttttgccagtctttcgtcccattttttttcaaaaatattgtaaaaatgataattcgttgccatggaccgatcgatcgtaaaacgcgaagtgagcctatatgtaatgtagttgctacagtccagaaacatggccgtcctgttatatatctccctcttatgttttttaagccaaaagagtttcgagataatatgatatgggcggatcaaggccggattcacagaagctatctcatttccgtaatctctccgaagttccaggctctcttccactgctcttccatcagcccatatcataccgttcatcagaggttctccgtcctctcttacaggcgtaagcgttggcgtatggctgctgatacaaagagctgcaacctggtccttttgaaatgtaccctctgccaaaagtttacccacgcaccacacaaatgcattccaccaatcttttgggttatgttctgcctgatttttataaggagttaccacaggataactcttataagcagatatcgccactctttccatactggtgctatacgccagggccttcacaccattcgttccgaagtcaaaccccatcaaaatcttatcgcacatttacaccgccccttttaccgcctaataaagcgggtattttccatactcatgaatcgcttcatacatggcaatcacattttccatcggcacaccaccctgtatgttatgggagggcgcacacagatacccaccaccctgtcccaaatcatggattctcttttttacctcgtttctgacatcctgctcatttccaagagccagtacatttacactgtctattcccccgtggaaacaaagacggccaccaaattcccgtccaatcaattctgtatccatgccggcagctgacggctgaatcgggtttaagatgtctgcaccggcatctataaaatgcggaataaaaggatagacgccaccgcaggtatgaacggaaagttttccctgaggattgtattttctgaattcttttttcacatgactccattctgtttcatggcgtggttttactacctgtacataatatgccggattgatcagaggaccattctgggtccccacatcttccccattcaaacggacataagtgagatattcccctatggtatccataaccattgtctctactttcatctgaatttccattgtcttatccataattgcctccacaatctcaggctctgtatatagatatgccaaataatcttcaaatcccagcagaaattgtcccatctcgaaaagatgtccgcccacctgacaggtaagcgcaaaatctgtctctctgtaaaggctcttaaccaacggcaccgccaaatccgggttgtaaagctcctccggttccggccagtgataggcatagacatctgccacatcttcaattccggccagaggtgcatctccattgatgtacataaaatctgtgtccgtatcccaaattttttttctgagaactccccactggtctcggaactcatcccgttcaatggaaaaatctctcggtacaaaagcatttgcagaaaaatgcataatatcaacatccagcttttccagtacttccactgaagcaaaagcatggttgcagtcgtcccaccaatagggctcaaaaggcacatgaagatattcacaaagctccatatatgccggcggcgcgattgttaaatcacagggtaccctgtccggctcctggtgattcagtgcagtttcaacacgctctcttctggaatatacttttcccatattcatcctccttttttatatctgttccctcacacgttctcctgtttccatgtcaaaaagatagagcagatcctccttcattttcacatatattctgcttcccttttggaaaaccagcatttcttccaatacaattgtcagaaaaccctcacggatacggacactgacaatcctctcatcacccaaattttcaaatacatccactgtaaattccgcatcgtaatccttctcttcagcaatcacaatgctggtaggccggattcccataatatactgctgtccatcttccagaatggatttgaatttgaccggtgcctttatcttcgtaccatcctgcagtacaaaacagaaaccgctgttcactttcagtacagttaccggcagaagattcatgggcggctcgccgatgaagtctgcaacaaatatattgaccggatcattataaatttcatccggtgttccatactgctgcaacactcccagcttcatgatcgcaatatggtcagccagtgacaatgcctccatctggtcatgggttacaagtatcgtggtacatttaatttcattgtgcagccttttaatttctcctcttaatatctgtctcatctttccatctaaatgggacagtggttcatccagcagcaaaatcctcggatttcttacaagggctctggcaatattcactctctgtttctgtcctccgcttagtccctctacttttttatccagcagttcttccactttcattacttttgcgatttctcttaccctttgatctatttcttttttatccactttatttgccctcaggcaaaaagctatgttattgtacactgacaggggcggatataaggcataatcctcaaatgccagtcctatttttctctctttgggatggatatcgttgatgactgtatcacctataacaatttctccttttgtaattttctccaaccctgcgatcatgcggagcgtcgtagattttccacacccggaaggacctaaaataccgagaaaagtaccgtcttcaatctccagatccaaattatttaccgcatagacaccgtcctcttttccattggcctggtcatacattttatacagattctgcagtttcagatcagccattgattccaccgcctctcataatctcctcattatgacgcaccagatactcctttgtcacactgtgaaaaaaaatacctttatccatgttaaaatgaagataaatcgcctcatcaatctcaaatttttcatctacatgtacaataaaacgaatcatatcatcgccaaggctgactgtaagctctactttatttccaagtggttcatgagtataaatattacctctgacataccctttccgcggctctctgctgtaatcgatggcccatcccctgaaaccgatatccacttggtttactcctgcagttctaagcttgtccttaacgtcatccggtaccgtataggtttcatccccataagggagacggatgactatttctccttcttcctccaaaaccaagccgtctaaaatattaatctcacagtctccaaaaagctttgccacaaattccgtctcaggcagataataaacttcactgcctgtccctatctgacagatagaaccttcatttattactgcaatcctatcccctaggctcattgcctccatataatcatgtgtcacatagattgttgtggtatggaatgcttcctgcatagatttcaattccttgcgcatggaatttctaagttttgcgtccagatgggccagtggttcatccataagaaaaacatttggatttcttaccaaggctcgtcccaaagcaatcctctgccgctgcccattactggcttgagtaggtttacgatctaaaagttctgttatattcatcatctctgcaacttttctcacttcacgttctaccacatcctccggctgccgatactttttggttctcatgctggacgcgatattttcatacactgttttgtgcggatacagggcataattttcaaataccatagctacattccgttcccttggctccacataattcatatatgcctcatcaaatcgaatatcaccttcctctgggtctgatatcccggctatcagatttaaaacagaggtttttccggcacctgcaggaccaaagatcacataaaattcattatcttttacatctatagatatatcctttagcgccgtgattttcccgtatctttttgtaacatgatccagtctgattctcgccattccattcacctaacctttcacagcaccgaagctcaatccccgaaccagatgtttctggatgcacaggcataacacaatttcaggtgctatggcaataagagatgctacagccatctgtccataatgtatcgtatccgttgcaatatacgtcagtgcggaaactgtgatcgtctggatattgaacccgcagagcattaatccaaaagtaaagttattccagcaaaaaatgaatgtcaaaagtgctgctgccacaaggccaggccgtataagcggtatcagcattttaaaaaacacctcaaaccaactgtatccgtccagttctgccgctctttccatctctacaggtatatcttcaaaatatccgcgcagaacccatatcagcagaggaagacctataaactgataaatccaaatcattccgaaatatgtgtcatacagatgcagtttttgaaagattgcgaacagaggaattatgatcaatatctcaggagcaaatttaaaggaaagaatcgtaaatgctactgtctcttttcgtttaaagttatatcttgcaagtgcatatgcagcaggcacacctacaagtacagataccagcactgctccggcacaaataataaaattatctccaaacgctttcacatagtttcccgtggtcagtacatttctaaagttatccagtgtgggtttgaatataaacagtgtcttgaacatatccacatcacttttaaaagaaataatgaccatccatataagtgggaaaaccgaaaaaattgtatatatcacaagaaaaaccgtactggcaattcccagcaccttagcaaaccttgatttattctgatacatggagcaccctcctccctatccgttgttcgtcgactttgctttcagccaggctttgaccaatttgctgcttataaaatttatgatcacccacaagactaatatctggggaactgcttttccgatactggaatatgtaaatgcatcccgataagcactgagtgacaagttcatcaatgtatctccaggcccgccttttgtcgtcgaataaataatagagaactcctgtattgcagcacatagtctgaaaataagtgttatcaaaataaccggcttcaaaagcggtagtgtcagagtcttaaatgtaaaccaggcacttcctccgtctatcatagctgattcataaggtgattttggcagcccttgaagccccgccaagataagaagtaatacaaaaggtgtatagacccaggtatcgatcagtataaccgaaaacagtgcagtggaggaatcagcggtccatggaaacccatacactccgaagaaattcagaaatctctccaccacccccacggatgaattggtcatcaatttgaaaagcagtgtagcaataaccggggaaaccataagtggaaatatcaagaccacttttaaaatcctggtaaagatattatcttttcgattcagggataatgcaatcactaaacccagtcccatctccaccaccagcgcggatatagtgtattttacggtaacccacagagagtgccaaaaatttactcctttaaacatttccagccaatttttcagccccacaaaatgccataccggttttttcagtgaataatctgtcaaagaataaaacacagcctggtaaaacggatatagaatccccaacgtcaccactaaagtaggcagtatgatgagccatggccgcaaacgcagattcacaggctttttattcaacttttttatctgaccgttttcttttgtttttaccatatttccccgcataacccaacctcctcatttgtgtaaaaaaggtcaaaaaaagcccgcccagacaccaatatcaaggcgggcctagttcttactccgtaatctctatatgtgaaacgatatcatccagtttttcttttagtttatccattccctcctgcgttgacgcgtatttgccttctaccagttcctgtagtgtctgacaccaggtctgtgacacctcgaaaaaatacgtttcgggagtataatacatctttgtgtaatctaccgtggcgtcaaaggtctccacaaatccctctgaatttttaagtaattcctggtatttttcctgatcataacttgactgtctgggagtattgacgattttagcacttacagatgattcattctgatattctttgcctgaaaaatactgcaggaacaaccatgctgcatccttgtgggcagacgcactgttcattgccagggaccaggtccagagctgtgattttgtatctgcatctgtctttccatcaggcagcgggattggcgcaatcaccagattctccgcttctgctgcattttcgggaatagtttgggagaacgcattgttggtagcatccagcataatggctgctgttccggctcccaattctcctccgcatgaagaccaggtcgcacttgcccatgtaggacttcctccctcccggatcagttttacataccagtcagtcatttccactgcttccggactgtttactttagagataagcttccctccctctgcttcaaaatcgatagctccccacatcttatacagactctgataagcggtgatgattgttccccatcctaattctccgcggagagcaacaccgtaggagttttccccattgtgtttctgaagggcttttgcagtctccaaaagctctgaagtagtttttggaacctgtagtccgttctcatccagaattttcttattgtagatcataacatttgattcaaagcccattggcaggcctaaaagaggaccgcttcccatttcatgaccctccactccatcccagcgtgcagaatccagtattgactggaagaaatcatccggatcaaaattcggatcagtctttttatcattgtcaatatagggctgcaaatcttccatatatccagcacttccatattcccaaatctggtaaggtccggtcatgaaaatatctaatttatctgattttgcatttaaaagagttcctatcttatcaaaataatttgattccggtatggtcgaatgctctacttttattccggtgagtttttcaaaatcttccattttctctataatcggtgcaacatactgatgttcgttgaatagtactgttatagtgtcacctgaacacatatcccaggagaactgtgcatttttactattctccttcccctgcgatacctctttcttatctgaaccgcagccattcagcgtagacatcatacatacagataaaatgattcccaaaaacttccatacccttttgttcttcatacggttttatcctcctcccgttcttttggtttttcatctcttatataaactgtggagacagaccgtgcgcactttgaatctatccttccagctatacaattcacaccacagtatctttccaataatttacaggttcatttccgcaaataacccgtactcctttcaatctgagctgttccacaaactggatcggagcaccccagtctgtaagtacagtatctatctccttgatgggacagattaaagacaaagaatcatcaccgaattttgaatggtccaggactataaatgactctttggatgagttcatcactgctcttttaaaattcgcttctcctatatttggtgtggtaaaaccatgctccagagaaaggtgattcccgcttacaaaacctttatcaaaaaataacctgcgcaccatttcatctgcaaaatttcccgtgcagcagaggattctgtgccttacctctcccccgatcaagacaactggtatatcttctgcttccgcaagctccattgcaatattgatggcattggtagtcaccataatttttctcttaggacccttttttatcagcctcgctatctgtaaagtagttgttcctgaatccagcatgatggcatctccgtcactgatacattcatatgcggcttttgcaattgagagcttttctttcaggtatttaggaaccttttcggaatgggaatattcctgtaaagatccttctacactgacagctccgccccacgtcctttttatttccccctgtttctccattttcataagcatcttccggacactgacctcggacagttgaaatgctttgctaagttctgcaactgttaccgatgattttgcattcagcaaacttaatatgtactgcttcctctcttcctgtaacattgcttcctctcttttttctttacttgtatccatcttctccggatgccggctagttcgtctgaaaatagaatctgtgcttatttagctttgctaaatatgatgtgatttcatattgtatttatatgttaattttacaaaaacagatagaaattgtcaatctattcatacatatttcatatatattcggcatattgtttatttttgtctatctttttagagtatatattacaattttcagtttcattttcccatttttctctttcgttttgagtgccacttgaaacttttcgtaattttcgttatatttcagacgagtaaaatatatcatttggaatctttttctcctctttccggcctctcctttccttaatttgcaactaaatcaaaagatttcataacattttataacctgctttacatgaaatctaaagtcttttggaagtattataatgaataacggcagataataacagacatttgcctgcatttaccgaatggtaaattttgccataaagaattgataaaggaataacagatgaattcgttagtatatgaccctctccgctttcggcctgacttgctgcagactataaaaggtgccgcagactatgcggcacctcatcatagaatataccctgcagctgcaggaaatattgtcatttgatcaattaccctcaggtaacagaagctctgtagatggaatctatagattcctccagcatcttattaaactcttgctctgtctgatccacattcagtccctgggtcagcgctctggaaaagctggcgatcagacccggattcctggctaatttttcattagcctcatcccttttataaccaccggagagagccaccacacgaaccacatgggcgtcttccataatatcagaatagaagccgtccacatccgggatagaaagcttgaacatgattcttatgctgtcatccagttttgccagatgttctttcagatatcccttcatgatcctttcggactcccctttgtctgcgctgaaaatgtcaatctcaggttccaggatcggtaccagtcccgcctccgcgatccgaactcccagctcaaactgctgttccacaacagcgcgtattcccgcttcattggcttctttaatgactgagcgcatctttgttccgaagatatgacgttcctttgcccgttccagcagttcatccagtcccggtattggtttcatgcactgcgcaccgttctttgcaggtgcaagtcctttgtccactttcaggattggcaggatatgcttctcttcccacagataatctgccgtcagctttccctcaacttcccgctccatggttttttcaaataaaatggctgccaggatatgttctgaagtaaatgccggactggtcatgatccttgtacgcatggcgtggaccaggtcaaacatctcttcatccccatgatagctgtcctcagagataccataaagccttagcgcctttggtgtactgccgccgctctggtcaagtgctgctataaaccccttgccccaacgcattcgatccaactgttccgtgttcatgcttcctcctttcgccgtttgtcagtatccatgctctgtccgcatacggtgaaatctgaccttcctcatacgcaggcaaaccggctggctgcgcggtcttgcgtttctgacagcaaacctgctgctgtcatcattgtcatgtcgtctgcaatacccggaatatagtaatttttactaaatccataagaaaaacatatcactttttatccattttgtcaaatgttatccaataattcttcgccggaaatccccggttctgtcatggagtaaggatttaagatcacattcaactcttcctcacccagcaatttgtctcttaaaataagactccgcacagaagcacctgtcaagatagcttcttttgcaagaactgcggctttctcatatcccacatgaggacatatggcagtgataatgcccacgctgttctccaccatatttctgcagtgctccctgtttgccgtgattcccgtaatacagttatcaaccaaggtatgcaccgcaaatgtcagtgtctcaatagactggaaaagattgtagaatatgataggctcaaaagcattcagttccaactgtccggcctctgtagccatggcaatggtcatatcattgccaatgatattaaaagccacctgattgaccacttcagggataacaggattgactttgcccggcatgatagaggaaccgttttgtctggcgggaagattgatctccccaaggccggctctcggaccggaggacatcagacgcaggtcattggacatttttgacagatttactgcacatgtcttcactgcgccggatatggaagtatatccatccagattctgtgtggcatcgatcaggtcataggactgaaccagatccaagccggacaccagtgctatatttttcaccaccttctgaagatactgcacatctgcattcaagcccgttccaatggctgtaccgcccagattcagggaactcatctcctccttggcatgttcaaatcttgtaatatcccggcggatcgccgtggcataggccctgaactcctgtcccagacgaatcggtactgcatcctggagctgagtcctgcccattttgatcacgtcgtcgaattcctctgctttttccataagcgcaccgtacaaccgttccaactgctcttttgcccggttcaaaagcttcagtgctgtgatccttccgcaggagggaaatacgtcgttggtggactgcccgtaatttacatggtcattgggattgacaatggaataatctccttttctcccgcctaagatttcaatggctctgtttgcgatcacctcattggcgttcatatttaaggatgtccctgccccgccctggatgggatccacaataaactggtcgtgaagcctgccggcaatgatctcatcacaggcccgcacgatggcatctgttctttttttatccagccgccccacttcaaagttggtgatcgctgccgctttttttatctgcgccacactgttgatcaattccggatgcatattcatgcccgttatgtaaaaattctcggcagcgcggagggtctgtaccccgtagtaggcctctgccggtacttcttttgttccgatagaatcgtgttccactcttgtcttcatgatcttctcttttgtttccatatcttccttacctctttttcagcagacttcacctgtttttctcgcctgcggtgtttttttcgtgagacttctattgccaacccgcatccccggcacggatatctgagatcacatttcaggttactattcagcctttcggcttcatagcaacaaaagcatgcacatagactgcaaaaaccgcaatccggcgcgtggctgcctcgagattacctcgcaaatgcaaagcaacacctcgcataatagtgaaaggctgaactgttaccatttcagagcagcggcctcagcagaagtcttttgttatctacattatacgttcggcttttattagaagctaatacatatatgtatatatttattataaataactatttatataccggaacattcatggtaaaataaaaaataagatgtaacggttccgcagatctgcgcgtttacagcgctgactgtaaaaaatgttcggcagccgtgcagagcttccatggacaacggcgattctacacggatttttgcccgtaaccgtaaaggcactgaaccgttgcagtaaataaaaaatgcaggtggaatctatgtttgaaggaaaaaaatacgtttacgaggtttataaaaccagaagcttttcaaaagctgccgccaacctctacatctcccagccctccctgagtgcaaccataaagaagattgaaacccgtctggggacacctatttttgacaggagcaccagcccggtccggcttacagagtgcggggaaaaatacatacattacgcggaacatctcatggatatggaaaacgaatttgagaattatttaaatgactttgaggctctctgtaccggacacctctctgttggcgggagtaatctatttgcctcctatgtcctgccgcctctgctctccggttttatgggaaagtatccatccatagatgtaaaaatgacagaatccaccaccaacgatctggaaaagcagctcttttccggcagtctggatctggtcattgacaactatacgttctcagacaccatatatgaacgccactttttctgcaaagaacagctccttttggcagtgcccgccgcgcttgcccataaaaaaggcctgaaagccttctgtctggatgccgcctctataaaaagcggttcttatcaggacaatgccgcctgtcctgatatcatacaacatttttcatccgaccctttcctgcttctgcgggcaggaaacgacacacgtgagcgctctgatctgctcctgaagcacgcgggtctcacacccaatgttcccctgaagctggatcagcaggtcactgcctaccacttggcctgttacggcatgggaatcgcatttgtcacagacactctgatcagacacgtacctgaggactccaggatcgtcttttataaactggaaccggaaatttcccagaggaatatttacttctatcacaaacgctcccggtatgtgacaagagctatggaagaatttttaaaaatcgcggattccggcatccacacattctaaaaagagatggagttctgcctccatctctactcattcacaacagtcttagcttttctatttttccttatgataatacttcctgccataggttctggcctcatcctccagccaggcgatttttttctgcatatcctctgactgtcccaccgggcttaaatcccagaacacatagccgccgccctcggcaaattgatcaatggccgttctcgtggactgccgtacagtctcctgggatgccccgggcattccggcctttccctgagaatcccagccgccgtttaggacaagacgatttccatacctggctttgatccctttcagatcgttcataacctgagccggctgccagatattaactcccatttccacaaaatctggtatgaccttttcacagcacccgcacatatgaagttcaacaggcagttcaaattcctttgccacatctatgagcctctggtaaaaggggcggaacctggccctgaacgtctccagggagataaaaagattggtggcagaagccatatcatcatcaatgatcaccacatccggtttataaatggggatcagatgccgcatagcctcctctgtcagcacagtaatcgcttcaaacagctcatccaccgcctccggttcctccaaaagcgcgcatagcccctcctcaaatcccatcatgttcatgagaggaatgaaaaagttgcccccgcagccatctgtcctgtagcccatggccttgttgggatcatgtatttttaaggcttctgctgccatctgctcccagtcaatttttgatgtgtccgggaaattcacaaaatctctccattttgtcacatcctccagcagccttctgtttggctttggcatcttgcctgcctcgtgtatttcccactccacattgaaaatatcgaattttctctctttatttacatagtccagcataaacccagtaaatacccagtcgcaggcatcaaaatataaagggacccagtccggttcttctccccggatgactttcagatagttctctttctccgctgcctcgccgcttactgagctgctgaatttcatccagtccagtaccatgttctctgccatattccattcctccttttacataaataccgcaatggccgaaaaaataatattaatgacaattgacggaaggataacgctggttatgcaggccggataagattctttcaaatccgttcccgcaaaccccataactccgtgcagtccgcctgagtgtggggataatgtgatgccccccgctgtatttgccacagttatctgtcgcagcagacctgtgtttacagaaggatttgccagccatcccgcgccaaaggttcccaaaacggtctgagcggtcacagcgcctcctcctgtgataaatcccgttacacttcccgctatgagacactgcatatacggattgcctcctacatcctgaacagcctgggtaaaaagctgatatccgtgagagccggtgataacgcccagaaaaccggcaattaccgcagcggcaaaggtgggactcagcccaccggccatacctttaaatataatatccttctcactgcccctgagctttttcagattcagcagataacacacaatgcaggctgttcccctggatgccaggatactgttagaggacgcaagcctctgaatgccggcaaaagcaaaccatccggacgtcaggccggtatacaaaaggatcaccagaatcataggagtcagcgctgccgccagtcccggaagatcatcacgttccggtttcaccatttgcctgtctgactctgtctctacatatctgcgtcctttttcctcccatcgtttttctgtccttttgattataaaatatcctgctgccgcatagagcagaaacattgccagacagataaacggcactgtccctgcggacacttccagtatctgggacaccacagtatttaccatactgggatttcccggaaaaagctgtgcggtaaacaatcccagataaaaaacagagagccagattcctctgttgatattgaattcctttgacagcactactgccataggccatacaataaatatctgcacataagggtttaccccgcccagattcagcaggcagcacacaataaacattaccagcagtatcttttcttttccaaatacatccaccagcttatacgcaatggctgaaacagaaccggaacgtgacatgaactcagaatataccgcgccgatggtgaagatcaaaaaccacgaaccgaaaaatcccaccagcccgggcatatagtaatcactgaagatcgcccacaatccaataccgcttgtcagccccacgatgacagcacagatcaggctcacaaggagcatattccactgtttaaaagccaggaacaccagcagagcaattgccgccactattcctatcacacttaccatatgaatcctccctttctctattacctctaatctcttggcctgaaagaagatcttctttttatgcttacatcatagcatcggcaagtgtaaaataaaatgctcataacatcgaaagcttttccggctctttcctatattttgtagcaatgccagccgcctcacgcatctatcatctcaaataggatcataagatataatcttgtcctgtaatcgtttagctgccagccggtgatctcttcaatccttttgatcctgtacaggtacgtggtccggtgcacgtgcagaatatcctgggcaatgactgccctgccgctgttttcaagatagattttcagggtgtgcagcagctctgttccatgcttccggtcataatccataagggcggacaggggcggagctatataaaattctttgttgtgcttcagacaggcagtctttacgatatactccagaatatatttttcaaataaatagactctctttgaaggttccgtctgattgcctgtctcaaaagcaatgacagcctgatgaaaatacatgcctgttttttcaaaatcatgaaaccaactgctgcagcctatataaaaatcgtgacggccggcaaagctctccaaaatttcatatatttttttgttttgtccgtttgggtagcgaagaatgagatgaatgtggttttcgtgaacaaaggtatagttgctgtccaggatccgatgcaggtaaagcatgtgttcggcaagcctggaatgacggttattctctgaaaagctggaaagatagacatagagatacgtatctgacttttcccatccgtaagaccggagtattggatcatatgcctccagataaggccgctgggaaagtgtgagttccctcaccatatggtcaaactcctttgtctcccccagattgaccgggcaaatgtcgaggtacgccattttcacatagtcagatatgagcattaaaaaggacagatcactttctctgcagggacggtacacttcatctgcaaccagtctcccaagatactcctgcctgtgaaaaatattgcagtaaatcttccgaaacccgtacatcttctcagaaaagattccgggtatctttgtctttaaggttgccttgtactcagggtctgagaccaccaccatgtactcatcttccggaagataggtattttcagccagtgaaaaattcttataactgctgttctttccgggcacatacatcatgatgcgaaatacaggcgtggcaaaggaaacaggattctccagtatttcaaaaagtattcttcctatctcgttcataggcgcatggtccacaagacatcttaagagcctcacctcaatatcttgaaacagccggaaaacctctgctgcttcctggaacagcttggcgatgtctgtcccctcctttatacagatgtattcacagggaatctctgtataagcatccggaagctgtcctatacagataagggatacgctgtcttttgtctctggaacaccggggagacttttggcatctgctatgcagaggctggatacctgccacatttttcctgtacagatctctatcttatccagataaaaatcaaaggggcggctgatccgcttttttgtcacctctgctctgtccagatgatcaaaaataatcgtcatattcagcttcatacctttttcctcctcaaattgtgcagatccctgcctgtctttttttcaaaaaaagacagaacaagcacagcttctgcctgttccgtcctctgtattcccacgctgtttgccccggaatatatctgaagcttgtcgggaatggattttcatacacgtcccggcattttcatttattatactctcaaacccgtgttatcacaatacctattcaagcccatatctcctgtagcaaaatgtaaaaaacagcaccacaacaatgaaattgacgcctatgatcatgatgctgcccgcctctgctgtatgtgatcccatatcctccatgatcctgctgacctgctgtgagaagatatattttgacaccttagcaatcttctcattgaatgaggcaagcatgggaagaaaagagaggatcatcataaccggaaccgatatggaagtggccgccatctggcctttgctcctgactccgatcgcggctcccaagagaagggagatcatgatcccaacgcacatggcaaacacaaaaccggccagctcctttccccggaaattccccataaccccgaagcatatggcccccagagtacatatcataaatacatatcctccggttcccaataaatattctccggccttaacgttagacataagcagcacacgcagtgtattgcactctttttcttccgagataatggcagccatggctgtgagcggtgccatgccaatgtacatggtggcaaagagcgtgacaaaatagtttttcggcattccctgtatgtccatggcattctgcatcacagcagtcagcatgggaaacataatgaactggatcagtataaccttatttttcaaagtatcttttacctgttttttccacacggcacatatctttctcccatccatactattcaaacctccttccggtcagttccaggaagaccgtctccagattcggctctgtggaatggatgctctccacctgttccgacgcaaaaagctcctggatcctgccggcttctttcttctcattttgaagaatgatctccctgccgtttttcagcagaatcttaatcctgttctggtaattatatttcctgcagatttcttccggttttccgtattccacgatctttccctcgtgaagaagggctacatggtcgcatagctttgccgcctcctccatattatgtgtggtcaaaaagatcgtcgcgcctttcgtctgttctctgcggatcagatcatggatctcatttactgtggaagggtccagggcacttcctggttcgtccagaaataagatttcaggactgtgcatcaatgcccttgccatgaccaggcgctgccgcattccctttgaaagtttgctgaccggacgtttctctgcctccaaaagacctactccccctaaaatttcccggattttcgtcttgggtatcctgtaaatctgtgcaaacagtgccagattgtcacgacagctcagccgttcatataatcctgtgttgtcaagcaccatccccatttttgtgtaaatactgctgctaagcgctctggtatctgtccccagcacttccgcccttcctccggtctgcacaagctgccctgtaaggattttgatgagggtggttttccctgctccggacggacccaaaaggccaaagatttccccttttctgagtgtcagatcaatactttttaaaactgttttatccccgaatctttgggtgatatccattattttgatgctgcattcacaactcatattatgattccttcccttcctctttccatttttccttcatccgtttcagtccttcttccagcttgcggtcctccgcctttatcttcagtctcatgacacctatgctcaccaaaacgctgacgaaaaagcttagaaagaagtacgcccacggctcccacatattgacaggaaaccatctgaatttccatattgccgcactggtgatcacaaaaattgacaggagcatgtatactgtccgcctgtttcctgacatatgcttaaaaatcttctccgaaaaaaacagatactgcatacatgtggccaaaaaagaagtcagcagaaattctgccataacttccagagggattccctgctttccgaggcggaacatacctgagatttccttggcggtttcaccaaaggccagagcgaacagtatgagcattgccgcagtgattccgtaaatgcaaaacatatttcccaaaaagtcaaataccgtcttattcttttccatacactaccgcacctccagtttctcttttacatactctgcatattgtctggacacgatcagtttttctccgtttgtcattgttacaagaagacgccggtttagctctgacttcaaggacgcaatgtgtctaaagtttataatgcaggacttatttgccctgaaaaaatcagcgtccttcagttgttcttccagttcatagagtttaagctcagtctcatatatctcatttttagtgtacaaaaatgttcttttatctgctgtatcaatatacagcacatccgccgcttcgatcagatgcatctccccctccttatgtcccacaagctgtttattcagcatatgcagcatggagagtatcttctcgatctccggcgtcatgcctgggcaggtcacgtggatattgatctctttctcttctgcgtccgtgtgcactgtaatcttcacgctgccatctcctttcccttctgtgtcaaccatagcagactccgtccaaatgcgcaacaggccggaaacccagttgccccatacggcagctaagttgccggcgcaatgcttgtctgccttgaaaatacttctgacggtatctcccatgcccgtctccgaaatacctctgacggctctccagtacataccgcaaaaaatatcaagtttctatctctgtttcaaattataatccttttatcaaagaaaggaatggtaaaaaatatggaaaaaaccaatgtatttttgaaaaatttttcgggaacaagctatgaagtgggaacacagataggaaactggatattgtctgcccctgatctgctgcagaaagctttgcttcctccaaacacttatccccgggataaatacgcacagatcactgctcttctggacaggtactgtcccggtatcaatgaggagatcagaggattttcagatacagtcggtgtgagaggagaacagatcattttctatgcaatgacatatctggagcgcgggtgcagcctgatggcggcgctgccctccaaaacagaaaacggccatactatgatggcaagaaattatgattttcatgatgagttggaagaaatgtgctttgcttatacggcgattgaaggaaaatacagctatattggctcgactctgcatctcttcggcagaggtgacggaatgaatgaacacggtcttgctgtctgtcaggccggcaacggacttcccgtgggcaatttcgagggtgcacaaaaagcaggtgtgacaggctttcagctttggatcgttgtccgcagtatactggaaaactgcaaaactgtggatgaagcggtccattgggctatggatgccccgattggttttaatatcaatttgatgttagctgacagctgtgatagaatagcattattacaatgtattgacggccataaatcttacgaaatcctggatggaagcagtgacaaaacgtatctcacttccacaaaccacaccctgtttgaggagatcaaaccttacgaaaaaatggtcattgaaaattcccttatccgcaacaaaaatatagtaaaactttttgaagaggaccgacggatttctaaaaacgacataaaaaacctgttgtctgcctcgtatcccgaaggactctgctgtcactattataaagaatttttcggtacgctgcgctccatgatctttgatgtgacggacaaaaccatagaaatgacctttggctcaccacaggcaaatgaatggcagactttttctgtcggcgtattggacgcaggagtaacccaggcgctgcttccccaagaaaaagcggaccgggatttttacaaaatactgtaaggaacagatcaaagaaggaggtatctgtctttgaatgaccatcaaattatcggacaggctattgtattcattgagaatcatctgtatgaaatgatcacagcccgtgacgctgctgaggcggtttcctattcttattatcacttccaccgctatttcagcgcagttatgggtgaaaccatcgggagctatataagaggcaggcgcctgacacaggcggcgtgggaactgactcacagcaaaaaaaagataattgatatcgggctgtctctgtattttgaatcagcagagagcttcacccgggcttttaaagacagatatgccatgacacctacggaatacagaaaacgcggaattgatattttgatcggaaaccggcagtcagcacagatgcccgaccaatccattgtcacccatgcgggattacatcctgagatcacggtcatacctgccgtgactatcatgggtatccggttccatacaacggtcagcggcaatgaatcagtggccgcatggcagcagtttaacaagaaggttcctgccgaactgctggcaaacaaacggtatggcgtctatgaagccggatccacctgttcttctgatgactttcatacagacagtgaatcttccgcctttgcaggtgttgagattcccgacaattatccggttccaaaagatatgaaaataaaaaaactgtgcggcggaacatacgcaaaatttacccataagggaaccgtagacaccctgatccggacatatcattatatctggggtgtctggttccccaaaagcggttttgaacttgccggacgtgatgactttgaatgctatacagaacgttttacaggcccggatgatgagaattccgagattgatatttattttccggtaaacgtttagcactttcataactgttggcaaagactgcgcagaacagccttcgccacaggtaaaggaaatcagatcagccggctgctcaacagttcttcataagcctgatataaaattcaacagtctttaccagggttttcacaggaaccctctcattgtttccgtgaatcattcccctctcctcttttgacagcttcatggcagaaaatttgtaaaccctgtcagtgatcctgcagtaatgccaggaatcgctgcaggccatcatgagataaggtgaaaccagtgcctccggccaggtgtcacacactgcctgggataaaagttcccactccctgcaggaggtatcggattctgctgaaggatttcttccctccaccacagacacctttatatcgggatcatggatgatatgtgccagataatccctggcggattccacagtatccctgccgatcagcctgaggttcatacccacagaggctttgggcggaatgacattgtaagcttttccgccttccatttttgtcacggcacaggtagtgcgcatcatggcattcagctcaccacccgacattttgcataccttgtcaaatacaccctcaaaacaccagagatttgcaaatatcactttgtaaagaaacgtagaatgacgtcccagtatatccagcatctccctcacaggctttgtgagctgacgcggaaacggatggttctctacctctgtcacagcctgagctaactgtcccacaatggtgtggaccggaggcatagaggcatgacctccattgctttttgcatggaattcaatgttagtaagccctttctccgcaatgccgataagggcacactcccgcgacacacccggaaatacattttccaccactgcaccgccttcatctaccaccattgccggtgaaatgccctttttttcaaaccaatccacaatggatgggcagcttggtccgttgatctcctcctgtccggaaaaggcaaagtaaatatcatgttccggctcatatccctctttcaggagctgttccgctgcttccatgatcccgcagagagttccttttgtatccagtgttcctctgccccataggacaccatcctccacgattccctcaaacgcaggcttttcccactgtgattcttccacaggaaccacatcgtaatgggacataagcacaaccggacgcccttcattttttcctttccagtggtaaagcataccgttcaccccgataaactgccgggtaagacggctgtggatctccggatagaccttcggaagcagctcctggaatttccggaattcttccttgtctatcaggctttcatcgttatacgatacggttttacagcgtatcatttcagccatatcctgtattactttttcctcttgcactgtcacctgttcccccgaaggcttccgctccggtttcggactgaacatagcggcccgcacaaatataacagccaaaaatccaatgactgctgccaaaagaacccataatatgatctgcagcatttcaaatccctcctataactttccatttttatataaaaatctcgccgaaccaatggcgatcagtgcccccacagggaccagcacacctaccgacccggatagggacggcaccaaaagaaatagtatgaccatgaacagcagcggggcaactgaaatcttccagttcttgctcacatacacaaccgccaggccgccaaacagggatggaagtatattgtcaaatgccggcttcactgccggattgttcaataccggtgtcagcggcacaagaagcgccacgcccaaggcgatcactatggtagtgacaatagaggaagtcgccactgcgatggtggagatcacctcacctttctctgtaccgggttttactcccgcattatccatagcggtgagcgccgcaggaactttcagattcgtcaaattccctgtgacaaaggccagataagacccggctgtccccagcatgggaacaaaggtcagtacctctatcagacccactgtccagaaaataggcgccacccccaataagcctgtgagcaccggtttccagcccggccaggcctgataatatatacaggtgacgataggatacgcaaaaatcatgcccagggcacagaggatccagatccgtccgtaaatatgtgtcatatcttcatatgttctgccgtttttcttcatcttgtcagcctcctatcataggtgtgatcatcgccgcgaatatcatagctcccagcatactgacaggaagcgcataattctccaaccatttccagccgcattttttaatgagtatcccgcagatccccataagaagcgcggaaaacagcaggacaaaaatggggatccatcccttcagtccgctgcggatgtcagagaacaccattccgagaaatgcggatatcatgcctaaaaacatggcagtcataaagatatcgccccatttgctgtctttgtttttaattttcataagaccgccctggatctttttgataaaaagcggcacccatataagacccgggaagatacccagtgtcatcacccagcagatcgctgtgtagaccctcgggtctgtcacggtctccgacagggaaatatgcagtgcatttgctgtggacgtagctgccggaagttcatatgtaatggctccgatcacgctcagccgcagccatggcagcggcagccctaaaaactttgaaagggtgatgacccccagcagtattgacaccgcaggagccagggtaaatacggctgttgacagtatggttttcctcatctgtgccgtttgtatccccagactttttccgcgtctgtaggccctcaccagaaaaaatacggactgggcaatgacgaacagaatcaccagtcctgccagaataaacaggaatgtactgtttggttgaaatttcatgctttctcctccctcatttcacaattctattaataatctataagtatccatcaaaaaagttctgtcttcccttccggaattctacagggccggactttcatccctggtcagcttccgtatccagttcccatagtgggattccaaaaatgccggaacgcacttaaatatctggtctgcattcagacagcagaccaccactgccggagatgccttcaccacaaaagccataaaaaatgacagtggaaggacaatgcaccagatgctgatcaaatccatctttaccacaaacatggcatttcccccgccccggataattccattattagtgggcatctgataggacattcccacacagaccacacttaaaattatcagaaatgtattcgccatatcctttgtggcaggcgacagatcgtaaaggctcaggattggaatgcggagaaagaacagcaggatgcccgaaaggatccctatcaccaggaacattctctgcattaccctggcatagacctttgtcaatgccatatcgcctgttccgatggtctttcctatgatgatagatgcagtggatgcagcccctactgccgtggacttgaccatcaaaaacaaggtggaggcagcactgttggcagcaattgccgcggatgtcatatgccccaggatcaccgtctgcagagcggtattcactccccagagactctgtacgaccaccataggagctgtgatcttaaagtaatctctgcagaggaccctgtcaaaacggagataatccttcaatctgagattcagattcttctcttttttgatcatgtatccgatcagcactgcgcactccacgatcctggctgtcagcgtgcccaccgcagcacctgctgttcccatctccggcgcaccgaaatgtccgtatatgagcacataattaattccgcagttgataaaaaacgtcatgatggagaggcagaatgcaatctttaccacctccacgcttctgagcgctgccaacaaaagctgggtgaccgcaaagaataaatacgtaaaccgtataagattcagataccgtacgccctcctcaatgatgtccctgtcagtagtgaaaaccccgaccacctgatagggaaataaactgaccagtacaaacaaaagaagggccaccacaagtcccgcgtgcatggctgcggcggcaatttttttcataggttcgatctgctttttcccccaatactggctgcagaagatcaccagcccgtcccccagtgccataaggatctgctgaaagacaaactggatctgattcaccgctgccacacctgccagtgacgtttcactgtaagcacctaacatcatattatccgccagattaacactgagtgtgataacattctgcagcaccagcgccgcataaatggaaaaaaagctgtaataaaaggttttattcaccctgctatgtatattcgtggtctctgtcctgcgtactcctgtcattttgctgtccccatccctcttatgtcctgataatacccaaaccaacggctctcctgactaaagtccatctctgtcacagagccgcagggcacagattccattttcacaaaccgctgtattaccgtctcatgggcaaccaggattatttttttgcagtgtaaatattttttcactgcaaaaaaggcgcgttctcccacctttgagaggctttcccaccgataacggcattcccggcaccactctcctctatacatctccatttctcttaatacagccgggatctcttccggtccttcatacataaaagacagatcaggcatccactcgtgaagatccgtctccactgtaagcggaatctgcgtgatccgtgatatgatcgacgccgtctgaagcgccctggtatagggtgaggacaggatcagctctgcgccctgcagccttgtatcctcagccgcccgctctgcctgccgcactcctttttccgttaatttagccagatcacggccatgccctatataccctctctcatcaatatccgaataatccggctcaccatgtctgacaagcagcaaatccatcatattctcccctctttccattttcttttctaaaaattatacctgtttttcccaattagcgcaatgaattttccttttcattgcaaacctttggaaggaatactataatataagaaatgtaacggttccttacctttactgttaccggtaaatagttacataaaaaacagcaggaggcctgaatttgtatcacatattaattattgaggacgataccgatatccgcagtgaactgaagctgatgctggaaaatgccctgtatcaggcagacagcattgaggatttttcccatattcccgcacagatagataagctttcccccgatttgatcctgcttgatatccagcttccgggaattgacggcctgtccctgtgcagggagatccgcaggaccaaaaatacacccgtcatctttgtgaccagccgcagttcctccatggatgaactgaacggcattatgatgggtggggatgactatattacaaaaccctacgttgcccctgtactgcttgcccggatagcagccgtgctgaaacgctccggcagccaaaacaaagcatccgactcctgtatcctgacctgccgcggatgtgagctgaaccttttaaacagcaccctgacctgcaaaggaaagacagcggagcttaccagaaatgaacttcgcatctgctggaatctgttttccagatgcggagagatcgtaccgagagaagatatcattgatgatctgtgggataatcagatatttatagatgacaatacgctgagtgtcaatatcacccgcatccgcagcaagctgcgcaagatcggtgtggatcatctgatcgagacaaggagaggacagggatactgcatatgaattttccggattatataaaagacaaaaccctcaccatactgcttcatttcctgtgcatcacaggcagttttatttacttatacacctgcggtcttaaaaagaaccagcttctgcttttttatctctcctggctctttcttctggctgtctgcctggtaactgactggtataagaaaaacagatatttcaaggagctgttccacattttaaattccctggacaagccctatctcatctcagaagttatgccggactctttccgcttggaagacaggctttacaaaagggtgctcagaagctccaacaaatctgtgattgacgctgtccatcatctggaatctgagcgcacagaatataaagactttatagaaaactggatccacgaggtaaagcttcctatcacctccatgaatctcatctgtgacaacaacaggacagctgagacaaggaagatcaaagcccaactggcagaactggaaaatgatgtggaaaaggcacttttttatgccagatccgacacggtgtatcaggactatttcatacacaaaattctgctgaaggatgtggttttgactgccatacagcgcatccgtccctatctgatcaaaaacaatgtgcagatcgatctgcatggctgcactgaatccgtatactgtgatgataaatggctggagtttatcctgaatcagatatttctcaatgccgtaaagtataaaaaagaggatgtatgccgcatatctattgatacatccagagagaataactgtactgcgcttaccgttgaagacaatggcatcggcattctggacagcgagatcggacgcatctttgacaagggattcaccgggaccaatggcagacataaccggcagtctacgggtatcggattatatctgtgcagaaagctgtgcagaaaactggggatctctatagaggcccggtcaaaggaaggggaatatacaaaaatccttcttcattttcccgacggcagcagccatttttcaagagacgggcaaaatgcagaggcgtgaaccaatctttcaaaattgtaaggttactgcagactacatttatatgaaacgtgtgtactttccggtatcatagaaaccagaacaggaggattcttgtacaccaaccggaaaggaaggataacattatggaagaattgatccgtgtagaagatattgaaaaatactacggaagcaaaaataatattacaaaagctgtggaccgcatctcatttaccgtaaacagaggagagtttaccggcattatgggggccagcggtagcggcaagaccacccttttaaacctgctggcaactgtggatatggtgacctcaggccatatttattatgatcaggaggacattacaaagctcaatgaggataaaatggctgatttcaggaaaaacaatctgggattcgtcttccaggacttcaatttgcttgacacattgaccattcaggagaatatttcccttgccatgtccctgacgaaaaaaagcaaaaaggagatccaggagcggaccagaaaaatcatggaacgcctggatattctgcccctctgcgacaaattcccctatcaggtctccggcggacaaaagcagcgctgcgcctgcgccagggcactgatcaaccatccgaaaatcgtatacgctgatgaacccacaggggctttggattccaagtctgccagaatgcttttagagacctttacacatatgaacgaacagatgaatgccaccatactgatggtcactcacgatgctttttccgcaagttactgcaaacgcattctatttctgaaagatgggaaaatctttcatgagctgcagaaaggctccaaaagcaggaaaaaattcctggatgaaattctagatgtgctctctctgacaggaggtgatggggatgctgaataagctggctctccgcaatgccaagcgctcttttagggactatctcatctatcttctgaccatgatatttactgctgccctgatgttctcttttgactccatgatcttctcagacgatgtaaaaaagctctgctctgaagccggcatgatgggggccatgctgggacttgccaccttttttattgtattgatcatgatatggcttgtacactatatgatgaaattcatggctgaaaaacgcagcagagaatttgccacctacctgcttctcggctttcataaaaagcagatcgcaagactgtttttaaaggaaatgctgcttctcggtctggctgcctttttcatcggcctgcttcccggcctctttttgcagcaggttatcaccacactgatctatgccattgtgcaggcagattatacgatccgtatccgttggaatatggggacttttttcatgacagcaggtattttcttcggttcttatgtactggcaatgttccggagtaaccggcggtttaaaaagatgaatatccgcgaaatgatgtatctggaccgtcagaacgaagagctgaaaaacgggaacaatacgggaaaacaatggatgttttttgcatctctcatccttattgtcctgtttgggtggatgttgtatttcggacactttaaccagtggaatgtctatcccatgatcggggcactcattgcctctgtttattttctctatatcggactgtccgcttttcttatcagctgtatccgtaaggggaaggcagcggtataccgcggagccaatatttttcttctccggcagcttgcctccaaagtgaaaaccatgcagtttacactgggtacactcaccattcttttcatggcagctctggtaggcgtatccgatgccctgatgctgaaccagtttcaaaatacccaggcagaggaaaagtacccctttgatgtctgcatttacagtgagcatcccgactatgatttctccaaagaaaaaacgctcattgaaaaatacgccgggatcacagatttcctggcctataacatttatcagaacaacaccaatgcctgcagccgctatcttgtggaacagctctcacagacagacagctcctattacttcaaatacgatacctatattcgtttaagcgattataaccgtctgcgggaaatgctgcgtcttgaacctgtatccctggaacctgaccagtatctgatacacacaaaaaagaggcttaaaaagaccattgctgccttttgtgcaaagcccttaaaaatccaaaacacagatcatacctgtgccgggatctatacggaaccctttgagcaaagcggtcacaatggtgctgattatctgctggtcgtcccggacgaaacggctgcatccatgacaccttattactctctcatggcagccagtataaagggaagcctcccagatgatttttatgatcaggtgctgtccatgcggggaatacacatgacaaatgactcctatgaagagcttgatgattatatagacagcctggaccgggaaaccggatcggacgccatctatatctcggataagctggtatttttaaaagaaaatgatacaagagaaatgaaattcctgctctccaccctgatcttcccgctgttttatgtggggcttgtatttctctgtgttgcccttacggtccttgccgttcagcagctttcagattccggaaaatacaagtaccgttatcagcttctgggaaagcttggtatgcgctcaaaagagctgaaccagatagttttccggcagcttgtcatctactacctctgcccctttgcaggtgctgttcttttgagcggaggcattgtaggctacatcagccataactttgtaaaatactccggtatccagaccccttcctggtcttatttcgggcttgccctgctgttgtttggcggtgtatatctgatctactttattgctacttatattgaattcaaacggaatatcatgtcaacgcaaaaaatgcctgatgtagaataacaaactttggggaagccagttttacccggcctccccaactgtctgcatcctatgcttttctgttttgaataaaatactgataagctcttcccacaaattcagcagctcctttgccatacatcttatccatgacctttactaatacattttcatgcaggtaactgtccgctgttctttcccaaaagtcttttcccatctccatcccttcgtacagtttttctgtcatttccacacattcctttatgatctcctgcacttcctccgcccccggatcccttgtcaggtcagatacaagcgcttcggtcatctctttattccgttccattccaccggattctctgagttttcgccctctttccatcaaatcaggcatacgttccatattatttttcatggcggctacaaattgctccatgctgccatagtgttccattgccgcatcaaccagaattgactcttttcccttccacttatccacccattcatcgaaggcctccatacttccaaagctttttataaccgcatcttcatgctctctcctgaaatcggacagcatatcaaaatattcttttgtatcaaattccgcaaagctcatacacctttccccctgttccagtttttccagcagacagatcattttgtccagcctcttcctttttgcctccaacaattgtttttgctgtctatacgctgccgttttatcgtaggccggatcctctatgattcctttgatctcctttaaagagaaatccagttctttgaaaaagaggatctgctgcagtgtctccagcgctccatcatcgtataaccgatagccggaatctgtcagcttcgttggttccagaagccctatctcatggtaatactgtaatgtccttacgctgatccctgaaagctcagaaacctgttttactgttttcatatgaatacactcccttctgtccatagctttatcttacactatcacgggacgtgagagtcaataggaaatcaaagtatattaaaaaattggtaaccgttaagctcctctgtcccgcctggtgctgccttgcatttgcagggcattcccgaggcagtaataaatatacaaaacagcatagccgaaatggctatgctgcaatcagtgataagatttcaccacgatactatttcattcctgaaccacaaagcgtgtctggaaaatactttccgtgagatgtacgggcacagtttgtggaagatttttctcgaatgaaggagacgcagcgaactgcgttgtatccttactccccgtgatgtttatttccatgcccatgttccccatcccggtatcccggatcaccggatgactggccgtcctgctgattttcctgatctccctgtatctctccctgcggttcttcccggatatcctctccatgtttcccgctgctctgtccgttatgtctttccacatgtccttccgtctcttcctcatgttcctggccatgatgttggcggtattgccggccgtaagaatgacatgcctcatctgcactcttctgcatatctgtttcctgctcattgtcatgacaggaaaccttcacttttgcctttcccccctgacactcctggtaggaatcgttctccataattgcctgcagcgcttcttggtagtgcattcctgtgacgtctacctgggagacgatgttttctccgtctgtgttcagtccctctgccgagatcactatgtccttgccgtttacggacagaccaatctcaaccggaccttccatggtgatatatgccgcctcggctttgatttcgtaggctctcatgctccccacaaataccaatgtcagcagcaaggccccggccagcgtccggtaaaatactggtctttggtagaaacgacgctttgagcagtgttccagttgggcggtcaggacttcttttgttctttccttcatctgttctcctgctttcacaggttcaaatgcatctctgatctttctgctcattctacgtcacctcccaccatttccttcagcatctgtctgccccggttcatccaggtataaatcgtattttcttttttatgcaggattcccgctatttccactgctgtataaccttcgtaataaaaaaggtagataacagatttgtatttgtccgggagcttccggacagcctccctgatgtaggataaatcctccttttcctctatggggatttcctgtacttcctccagggaagtatgcctgtgaaaaatacttttcaggaaatccttgcactcattgatagtgacccggatgatccaggccttttcgtgctcttttgtgtcaaattccggatcagcacgcatcagctttaagaacacattctgcataatgtcctgggtatcatcataattctttccataagaataacagatacgggttatggtatctgcatattcttccacaattaaattgatatcccattttgtcatcatgtgaatagaatcctttcggctttatatagtaaaatgttttattctccgtggtggtttccatgatttccgccgtgatgttctccgttatttccgctgtggtctccgttatggtttccgtcgtggtattcactgttgtctccgctgtgatctccattatggtttccgtcgtggtattcaccgttgtctccgctgtgatctccattatgatttccgttgtggtattccccattactaccgctgtaattttcgctatggtgttctccataactcccggaagcatccacaactgtttccgtgtatgtggaatccacaccttcactctgctcctggccaactgtgttactaagggtgttcgtctgattctgaccggaaacattctttactacattgacctggctttgaccagcagcactgtctgtaaagtcactctggtttgggtagtctgctccgttcacacactccctctgattctggcagtctgctccatttacacactccccctggttcccgcagtcagttccatttacacaatcaccttggttcctgcagtccgctccgtttacacactcccccggattccggcagtctgctccgtttacacactcccccggattctgacaatcctctccatacacactgcacaccgtattccggcaccacagacggctgtattcccctttgccgcctgccataaccactgtactcatagtacccgccaggatcacacctgctgcagctgccgccaaaacttttcttttatgaaatttcattttcattcctccaatttttctcttttatgatatggtttataagtttttctttcccggaatttaccggtcaaagagtgtgaaaaacctctttctattaataaaacgatcgtaatggaggaatcctttcaaaaatttaaaatattttccaaaaacattctaatcaaaaaatttacccttaaagaaattctcatttccaagttttttcgctgtcagtcggaacatcacacatccgtccgggcatacgatatccttgctgtacttaccgctgccgccaatgttctctaaatccccgccgcttctgactgcctccataacagggaacagtatcgtcattactttagaacagatcccttgtccgtctgcatttacagggcaaccatatgtacaggtatacttgtccccgatctcttcaccgtttctgcagtatctctccgtatgttcactgcgaaggaaccctatcacctcaatttcccactcatattcttcattataccattttttcatgactacctcctgctttctcttttttcagcatttctatatcgcggttaccggttacgatccacaggactttgtcagcggacaacaaccgtttcggaactgtttttattataataaaggagccaaaaaatagcaatacgaaaggagcgggcattcattgctcccgctccctctttataagctccttttaccgggcgttctttttactttgccctcaccacaagccctatcttactctgacagcctaatttgatctttctacactcaggtatgcgtccagtccttcaaactgttccagatagctgaccgcgtcctcataccggttggactgcaggatcagatttaccgtattgcagatacagcgtttcagttcacggatatccaaagttccctcttccagttcccggcggatattttcatggtcttttggtatacccggcattaccatatcattgcccgcacgcatacagcctgctgctgtacactcacctctcggtgaggcaaaggttgtcgtccagtctgtcataacagctcctgcaaatccccactcatctctggccgccctggtacagatatcatagcaatttgcggcatgtacgccgttgatcatattataggaggtcataatagacattggctgggaattcttcaccgcgatttcaaatcccttcaagtagatttcccgcagtgcacgttcggagagtacggagtcagatcccatacggttatcctcctggttattgcaggcaaaatgcttgatcgtggttccgcatcccggcactttctgcacacccagagtcatggcggaagccatgatgcctgacagcagagggtcctctgaataatattcaaagtttcttccgcagagagggtttctgtgaatgttcatacccggcgcaagccataaagtcacctggaaaagctccatctcttttcctatcatttcccccacttcttttacaagctctgcattccaagtctgtgcaaggagggttcccacagggatggctgtacagaactgatagtacgcggttcccacctccggtgacagctcagcaaaaaatcctttttcaatggatttcataaagttttcacgcacgatctccccgtccacaacctgatacttctggttcagacgcagtcctgcaggaccgtctgccagagctattgagggcaggttccatggctcaccggatgccgcggaggaagtctcagccgctgctccgggcacagtgatccccgcagaaccaaggactgcatcctggcctttccctggatcgcctgcagacatctgaataagctgttctacggaaagagattccacgatttctcccgccctgccggtaaaacgttccggcagttctgtgtaaaccactgtctcttttgttattttctccgcgtcaatatgtacagagggaagtcctgccgccttttcaagccacgctgtctccttctccttcatcctgctgctgtccggtgtcagctctgtcagctcctcttttaccgggcagatatgttcgcactgcactaaaatggcatccttgtccacgcacagacttcctgcaagcttggcgccctgaatggaatttccggtccagacgccataggttccttcccccagaacccaggctgcattttcttcatgaaaagaggcaagctgataaaccgggaatgtgatagttattctgcaggattctcccggcttcagttcctctgtcttggcaaatccggcaagacggcggtattcttttgccagttttccctgaggacaggaaacatagatctgtacgacttctttgccgcagtatgtatctcctgtattggtcaccttcacagttaccgcgatctccggctttccactttttgtatttactgttttgatctcttccgtacagatcataaaatctgtataggaaaggccgaaaccaaacggatagagcacgggtacatcaaatgtgtcaaagtagcggtatcccacgtaaatgccttcctgatacttttctgtattcacatccccgtttttaaaactgaaagtttcactgttcggatagtctttataatcgaaagcccaggtatcagccagcttaccgcttggtgtcacttttccggctactacatccgcgaaggcactgccgccctcctgtcccgcctgtacaaactgcagtacagcttttatattgtcaaattcctgcacaaaggccaaatccacaaggccgcctgtattgatgaccagcaccaaagaatcataagcttttgaaagctgggcgatcaacgctttttcctctgcggaaatataataatctccctctgtgtcgtgacggtccgcgttctctcctgctatacggcttaatacatagattgccgtgtccgcgccatcggctgaagccttatccacatcaaccggattcccacagggcataaaaaacggtgtggtggaatatgcttcaaagaaattgttgtcatatgcttctaatttccccagtatctcatcccgccatttcagccgtgtttcctcataaagggatgcataggcctccagccaggcgctgctcgtgatctcatatccggcattttctaaaccctggcagatattgacacattctctctcgtttacatcaccggagccagttccccccttgatggttttcaccgcacctgcaccgtacaggccaagttttatcccttttttcagaggcaggatatggtcctggtttttcaaaagcacaaagccttctgctgctgccaaacgtgcaagctttctgttttctgtctctctggccgtcacttcatttgaagtagttcctgtaaatgtcttgttttttaatttcatggtattcctcccggatcacttatctgtatttaccgtaactgttctgtgtctttccagttactatctgtcttttattatgacgaataaatcgggaaatttctacggctctttttaactatttataggctgatattgatattttcctcccggtttgctagaatattcccagaaggttctctgtcagtattgataaatcaaacgataactgttcagtcccctcacagttactgtctaaaaggagaaaagtccatgccataccattacgagaagatcagtgagacaaacggtctgcctgcaaaattcatgctctcccagtgcaaagacctgactattcctgcccactggcatgattatctggaagttttatatatgatgaaaggagagctgaccgcagttgtacaggccggttcctatctgctcaccccaggcagtctgatggtcatcaacagcaaagaactccacatgacccgggccaatggctctgtcagctatattctgctgcagatttccgccggacagctccaaaatttcctgccatccggcacaagcctgcattttcagaccatgatcacacctgcagagaaagcagatgttttttccagtctgcgccggaatctggaacatatgctggatgcctatacctgtcaggaaagtggctatcagttcttttttgcggccaacctctacgaatttctgtaccacctgtataaaaatttctgttccgcttccccctccgcaccggagaccagggccaacagagatctggaacgtgtcacacaggttatggactgggtgcgaaaccattttcaagagcagcttactctggatgacgctgccgcaagcctggctgtaagccgcgaatacttctgccgtctgtttaagagatacacaggacagacttttctggagtatctgaattctgtccgcaccatgcatttatatgaagatctgaaaaatacagacgacagtatcactgtgcttatggaaaaaaacgggatcagtaattacaaagttttcatgcgcacatttaaaaagctgtacggcgatacacctcagaagatacggagcgggatcagagaatatttttcaccggaactgccatcctaagtttatactaacttggaggtccgtatatatgtttccagacaaaatttactatgaagaagcagccatgggctatgaacttgggcattacctgaagcaaaaataccaggacagaacctggattcccattgacagccataataaaatagatgaactgcgcacacgcccaaattccgatttccgggaaatgaagcagtatctcattatcggcatccgcaaaacccatcggcatgtccccaatgccaaagtctctgactttttggtaccttacacttcatccggctgcattgccgcctgcctgtactgctatctggtctgcaactacaataaatgctcctatctgcgtctcttcgtaaaccgggaagaaatgcttgataagatcatgaaatctgcaaaccgctctttggaaaatctcacctttgaaatcggcagcaacagtgacctggtccttgaaaataccatcacccataatctggaatggaccatagagcgctttgcaaaaaatgaaaaaggcagtcttacatttccaaccaaatttgcaaatatcgctcctcttcttcccctccagcacggcggcaggatcattttccgtatgagcgtaaacccggaaaaaatcatccgccaaatcgagctgggcacctcgccgctgaacaaacgaatcgaggccctgaatcaaatgtgcgaggcgggttatccctgcggtatcctcattgcccctgttattttccttcccggttggcaggatctgtaccgtgaactgatcactgtcctctcggaaaaactctctgaaaaagtgaaaaaaaccgcgtttatagagatcatctttatgagctacagctttgtccatcgtaagatcaatgaggacgcattcccagatgccccggaactttacgacaaagaactgatgcaggtccggggccggggtaaatatgggtatcatccgtctgccaggcaggaaggagaactgtttttccgggcggagcttgccaggaagcttccgcgtatgaagattctgtattttagctgagaactaaacacacggcacacagacttaggccggtcggtcaaaaaatttctgctgtcattttccgcatggatactggctattttcttttctgtttgatacaatactatttatagaaaacacaaaggaaggaaatgcttatgcgcctggaaaaaatacaaaatcttctgaacgaaaaatctctggaatttcaatataacgaagtagacggctgcggcagcctggactttgattacagaggcgtcccttatcacatctgggaataccaggaaaacggctggggcgtggagacgaatgtaagacacgggggatataatgaagatatcaccggagattatgaggatgtggtcattcaggttatgaaagactggtagaaaacatatttcgagagaatcggggtgcggagaagttactatcttggtgagggtatgaagaaaagtctgtaaataggattcttctatgataagacttggtggaatgcttagaaattaggtattccacctttgttttatatataccatccagaggatggcatgtcaatagcaggcggcttttccgcctgttttaaccaaactgttttttattctggaagccgtccctcatacataatactcagttcaccgtagacctggccccagttccggatggtggtagtccacctttttgttgcttcaaaagtggctagatacagggctttcagcagcgctgtatcgctcggaaatacacttctctgctggtttaatttccgatacgtggaattcagggattctatggcattggtcgtgtatatgaccttccggacatctgctgaaaacttgaagatcggagaaatagaatcccagttatccttccagcgtttcatggaattcggatattttggtgtccatttctctgttaccctttcaagggctgcaagggccttcttttcatctgatgcctggtagatcgtctttaaatctgctgcaaacgccttcctgtctttatctggaacatattttaaggtatttctcacctggtggacaatgcatctctgatattctgttttggggaatgcagcagcgatggcttctttgatcccggacagcccgtcggcacaaaggatcaggatgtcttttacaccccggttttttaattcattcagaacagaaagccaatatttagagctttcattatctccaacctgaatggtaaggacttccttttttccttccgtattgatccccaggatcacatatgccgctagtttgcggatcaccccgttatcccggacagaatagtggatcgcatcgataaaaaggatcggatatacttcatctaagggacggttctgccagtcttcgatctgaggaaggatcttatctgttacatcagaaataaatccttccgaagtttcaaagccgtaaatatcttcgatcgtttcagaaatctgtcgggtggtcatccctttggcgtacatagaaatgatcttctgatcaatatctgaaatatctttctggcgtttttttacgacctgaggctgaaaagtggatttgcggtcctgagggacctcaatctccatggtgccataactgctgtttacgcgtttgcgtttgtagccatttctgtaatcctcgttatcagagcgttcagatttttcatatcccagatgatcctccatttctgcttccaacatttctttgattgttccaccaaggagatctttcagggcatcttgaatatcttgtgctgtttggatatggtattcctccaggagctgatggataatgttgcgtttcccttctgtcatttgtacccgatgtacaggtttcttttctcttgccataataaaaggccctcctatgatttttattttatcatagaagaacctttcaatcacatatttacagaaaaagtttcacactcccatcttggttgtatgaccagtaattttttcgcaccccaactttaatcattcatcgatttctatcattcgtttgtatataccggaagaacactcttcaatcatttttgcatttacacatttttcataaaaaggaattgctgattttgtgggccacccgattattgcatatgcatatcctaattcctccatagaatgaagtgatttcaataatagtgcctttccaattccctttcttctctcttcctccaacactgccataggtccaaaaaagtcttttgcagtaacctcaaaacaggcaaaccctatgatttttttctcctttgttgcaatataacaggtaatgggatgattagaaaacgcaatttctacctcatcagagtaatcttcatttgaacatgtctgggcaaatttaacaattttacttttatcaggtgctaaagctctttttattctaactccatgttctaacagcctatcctcctgctcagaaaatgagttgatattgtataatttgacaagcatatcagccatattaatctctccttataaacttattttaagtataatcccacttccaacactatttctaatactcagcttttaatgggcgagtatattcatcctgccagggcttcatcataggattataatttattcaatcttcctataaaatttctgtataagggtttttgtagcatatattaccgccgcgatcattccaaatacaacaataacatagaagatcccatactctctctgaatagactccggcggttccggtatttcaatgctgatttccctacgcggcagatcaccgttccatggctcatcaatacaaatccaaaagtccctgtttccgaacaagtatcctacatttccccagctatgcccgtctttgtctttgaaaaccggtccatagtaaacagtggtttcactgtctatttccatactatacgggttctcagagcctggatagttccattcgtaaacaacatcccccgcctgcatttccaatccaccgttctccttggtcagccggctctcatactcctctttaaaggacgtgctgtcatataccggatacatatacgccagcggaacccatcccttttttccattgccgtcaatatatccccaatcattattcttcatgtccgtatagatatatgtaacattgtaacagtcaccatttttcaatacagacggctttttaaaggagatggggctggtgtagagacttgtcctgccttctcgtccattgacaatatagctgcggtttctatagacacactgttcggaatggatgtgccagaaaaaatcactaggctcataaatgatatctccacgtacaatttctgcctgaaaaattaagcaaagcagtattgccaggagcatatattttccttttttcatctgaatctcctttttagcagtctggtgatcacttcttttttccgtatgtcccccagatcaaacatccggtaaccatcatgaccactgccacaagtccggccacaagccagacagaaactgtgatccctccgcctacccggtcaatagattccggcggttccggcatctcattgtcaacctcccgaacaggaagatttgaattggacggatcatccatacatatccaaaatgtatgccatccttgataataataatttacataagcccatttaagcccttcctcatctgtaaaaacacggtcataattgagggaatgtccttccgttttcacattattcaaattataaggatcaccggaaccgggatatgcaaagtaatagatcttctctccgctgtcaatatcaatactgccttcctctttttttatctgtgattcatattcctccagaaaggaatctcctccataatgagaaaacatatacaccatgggaacccagccctctttattctccgaatcctcaacaagtccccacttattccccttttcgtctgtatatacataagaaatatagtgttcctcattatttttcatgactgccatcactttgtcagacaacggacttttataaagttctgttttccctccgtagccattgacagtataagtgtggttcacatattcacatttatttgcatgaagcttgtaaaaggcattctgcggttcaaagatcaaatctgctgaaacatccgtaacatgaattcccaagcagacaaccagaatcaaaaataccctaactccctttttcatatgtatccctcccctttcaaatacactttcaaatacaaaatcccagaagaaatgagaatccgttagccgccagtgaaaaccacattggatgtctgccctcctgcagataagctttgtaaatcaatccttctgttataaccactgctgtctccaccgcaagatagaaaaggaatcttcctccatacggcatatacatcctccaaatccatgcaaggaaaacagcggccggatttgtcagtatattgaccagacagatcagcagaaaatccttaccgcgccttatcccataaaaccacgcggcggcttcctcgataacaagtgtaagccccagcgaaaccccaaacattttaatcagatacagtaccatctgccgctcctttccccgagtcaagccccttccgtttccgtcttgtcacaacaataagcaggaaaagagagattaagcttcccagacttccgatcactcgataatacaatggcggcatacaaggaaaataaaccgataaaaatcccaaaaacaaggcaaatgtcagcatcccaaaggccagccccggctgttcccgcatcgcattccacatgagatacagcgtcagaggcatagtcatgttaaaaaataaaagggctaatacccctgctccccaaaatctgccaaatccatacatcaaagccgctaaagcaagagaacccaccactgccctgtatatcccgatccggtcagccagaaatcctcccgctgccttaccgcctgcgacagccgcggcacataccgctcccataagaactgtattcttccagggaaacgcagccgacatccccacataagacctcagaaccactaccagaaaacagcagataactaccatacttctttccggcactgccttgtgcttaacaaatctgccccatgagcttccaaaacctttccctcgtcccagccacaggagcattcccccaaaacacagcaacaaaaatgtccccgtaaaggcgatccatgtcttatatgcaaaccggctccacatatttcccaaaaacagccccaaggctccgggtgccacaaaaatgcccaggcgtgtgcacacactgcgctctccttcactggtccatatcgtccctacaccgccccctacatgaaacagtgcatttccaatgcccataacgatcacatgtgtaaatccccccgccaaagtaaacacaactcccaaaacagcaaatacagcagagcatctatacttttccactgtattcttccctctgcagattccatcaagcaccacccccaacggcatctgcagagcaaaagcacagaaattatataaaagtatataccagtaccaggcatccctccccttaaataccccatacatggcaaacgcgcaggcagcatccacaagaaaatgcatacacgaaaaaacccctaaaacagccctgtcccttctcattgatgcctctcagatctctcccagcatctgcgccgggttatccgctgccttgaccttgccgaaggccttttctatgattccatcctcgttgatcaggtaggtggtccgcaccactcccataacctttttcccatacatatttttttctttccatacatcatattcccggatcaccttaagctccgtatcggaaagcaaaggaaagggcagatgatatttctcagcaaattttttatgggaagctgccgtatctttactgacaccaagcaccacagctcctttctccgtaaactgcggatacagctctccaaaattacaggcctgctttgtacaccctgccgtattatccttactataaaagtacaacacgactttcttccccctaaaatcactcagagccacttccttcccatcctgatccaacagtcttaattccggtgcctttattccaatttccaacatatctaatcctccatttcatattttatttttttttaacttgatcctgtctaccaacattataacttcacttcctgcctaacgcaacaaactgcgccttcatatcctcacttttaaataagtgggtattcaaacctcttctgttgcacagaaattttcccattttcttttgtaagtattttctaaaaatattcttgacattcctttctctccatgatatgatacaaaaagtgattaatttgaatttagagccgaccagacaatgattccatttaattcattgttgagttggcttttttctattttattacgaccaaatattatatatggaggtactgattatgaataacggtacagtgaaatggtttaacgctcagaagggatacggatttattactgattccaatacaggagaggatgtattcgtacatttttccgctattgtttccaatggattcaaaagccttgacgaaggacagagagtaacatttgatacagagcaggatccgaaagacagcagaaaactgaaagcagttaatgtttgtgcagcataattcctgactgccaaaaagaggccgcgcatttctatgtgcagcctcttttttcgtctttttatagcttttcagtttctaacagttacgggcaaaagcagaaagcagcccggatatcctgccctctgctgcgaatgcgtttatccatatacctttccataccggaaatacatttttttataccacggcaggtttttatagacataggaacatgctttcttatagacacggcgcgtttcccttccctgcattttagaaagctcttcatttccaaagctctcctgaagggctgctctctgtatctgtacggcttccgccctgctgatagagggaactgcatgggacagcttttctgagaaatccgctcccattgcgtcacagtccttcatcttccctgccatcccaagaacttccagcattctgaccatgatctgaccagcgccgtatttttcctgcctgcgcagaatggcataccgccgaaggcaaatcatcccccatataaaaacaatccctgctgccgcggcaaatattggtgccatcctgacaaaaaaggaacgaatactccccagtagtttatttctacggttctgatctaaaccactgtctttctgctccttctgtgcgctgttctcatcctcctgaccgttttctgttccatcagcagtctcttccttccccggttccgtccggccttcttcctcatccggagcagcctgatcattctgttctgctccattctctcggctggtctcatattccgttccggctgcttcggctgcagtctctgcatttggcatgtattctccgttttccaagccgttccctgcctgctgtgcccccgctgccggggttgtctccactgggatccatccttcaccgtctaaataaatctcagcccacgcatgagcctgcacatctgtgataaccgccttatatctgccgtcctcctgctcctcaaataaatccggcgctgccctaaatcccacggcatagtgggatgggatcccgtagatccggtacataagtgccgccgcagtggcaaaatgctgacagtatccttttccctgctcacatataaaatattctgccgggtcccttccaatgggcgccacgccgggattcaaggagtaggctgcatttgactggagccaggcctgtatgaatccggtaacctcttctgttcctgaattatcataagacctgcagatgctcacaagctgtggtacctgttcctcaggaactgcaagacaggactgctccacaaaggttttgtaggcacgctcctcctcctcaaatctgagtcttatatctgcgtccgccatagccagcactgttttaaagtcctcctctgtgtacatggttcccctgtgcaccttatcatccccatactcttctccataaatatagggcagcgatactgtcctgttctccagagccagagaccgcaattccacattcttttcacccggcacattttcatagccatctgtacctcccaaaccggagagaatataacggatcatataaaactgcctgttttcaaaatattttctggcgtccgcgccctcctgagccgcgtactctccgtccaagctttcataaaaagcctcacggtcggctgccttccaggcaccgctttcatacacatcacccacaaagcttttaaggtacagatcctccttgggtttttccgggagaatgacttccatctgctctctgccgcttggataaagtccgccccggtttacctggcccttgacggattccggaagccacagacctgccgccatgcgccaggcacgttcaccggtctttaaggggacctcgtacagggtatccatatgctttgaaactcctcttcccgcaatacccacagcagctaaaaagaagaccgcaagcacaagaactgcccttcccgcatttttataaatgccttcccttggctgtcctgatttccggcgggtcttggacgcaacaccggccatacggtttcccaaatgaaaaacagccagaaaacagagggtccatatatccaaatctgcctgcgccatcattgcggcaaacacaaggggaaaggtaataaagtaaaaaatccatccctgttttgccagattcgctgtcaggtaaataaaaagcagacccaaaatcatgcagatacacaacagacctgtcactttaataacagaaatcgctctcatattccacattccggccgcatacagcattttcatattggtaagatacacactccgctttgcccaaaacatgcctccggcggcggcaatgcccacaaatatcacaaagaccggtttacacttcacaatatcctgaagaagccaaagccccgcacaggctccagccaggacaaaggccaccggccacaaactgtaattcagcctgaagatcaatgagcacagccgcagatatccccagagcccgcaaaaataacagacgaaaaagagtaggccgctgaccggtccactggtttttcccgctttttttcctttgtcagctgagtaaaaatctctctttcttgatctcttccacataatcctcctctgaaaactgaaacagcagtttattgtataaatgtaatctgagggacgtgtccatggaaagaaccatttccccttcctcttgcctttggtacatctcttttaaatacaattcatccggatatcccttttcctcaaaaagcgcgtccctgcgtatcatttcacacagattgttcataatatcttcatggcacgcaatggaatacacctgtatcagcccggtctgcctgtcccagtatcctaccgaatggctgactttttccttcagaaggcctgcgctcaccccataacaaagctcccagaatgcgtccatctgctcggtgcttaaaggcttgtcctccctgatatcccagaatacaaataccggagcctgaacctctgcacaatactgcttgctgagcagttcaccgcttctggcagtcagtttccaatgaatatccctgagtccgtcaccggggcggtaagcctggacctgatagatttcaggcggttgtgctccgggcctgctgtttccgttttctgattccataccaaaaagcaggctttccatagaaaactgcatctcataaccctttggaagcaccactgcccgaaaggaagccgctgtctttttctgtccgcaaaagagacacagagggtcccaaactttcgccttctttccgctgatttccaagatcccgcagtgctttggagagacttccactcctatcctcgcagtgccttttcccggaacatacccctgtatctttttcgtttcggcattggatgtcccctgattccatatcttaagacgtacttcaaacttcatgacaggtacccgggaatgattgaccgctgccagtgtcattgtcatcgtactctcctttgacacagtattcctttccggctccagcccgatttccagtctgcgtaccagatacttagataaaattcccaaaattgccataaaaaccagagatgccgagagaaatattataacagaggaagaacggtaaagccccgccagataaaaaaacaaaatcagtaccagcgttaccagtaattttctcatctgtcatctccccttaaagaatggtctctcctcatgttccagaataccggcaagcacattctctttttccacaccgtccatccgcgctctggtactcagccttaccctgtgattgaccacaggaataaactgggcagacacatctgcaggggatacgaagtcattcccggctatccaggctgtgaccttagccatgcgcaccaatgatatggttcctctcggactggcgccggcttcaaaatgaggatttctcctggttgcagtgattagcttcacaatatagtgatagacagagtcatggacaaatatctgttccacctcttgtctgatattctgaagcacctgtgcattcagcataggcatcagatggtcagtccttcgttcaattccggttccttttgccatctccacctcactggcaaaatcgggataccccatagtagtgcatatcataaaacgatccatctgtgcagggggcagcatctgcgtgcctgccgtccctgtgggattctgcgtggctatgacaaaaaacggggcaggtactttcctggtcactccctccaccgtcacctgctcctcctccatgacttccaaaagggcagactgggtcttcggcgacgtacggtttatctcatctgcaagaagaagattacagaacacggcacccggctgatagacgaatctctgcaggtcttttctgtatatggaaaatccggtcagatccgatggcagcacatcgggcgtaaattgtactcttttccagtccagtcccaaaagctttgacaatgccagtgccagggttgtcttccctgaacccggcagatcctccaacagcacatggcctcccgccagaagagctgccagcacctctgccgtcaatgtctcttttcccaggattacctgattgatctgtgtgagcacctcccacacagcttctctgtttgatttcataagttcatatccccctaatcctttatctcctaatcctctatctcttattcctttatctcttattcctttatctcttattcctctatctcttattcctctatctcttattcctctatctcttattcctctgtcttttattcctgtatctcctattccctgtcctgctcctcctcatacagtcccagtttgtccagccattctttcacctgatcctctgactggtccgctttggaaccataaacagccagcccctctgctgcctctgcctccggacatatttttttcagatcctccacactgctgcccagcccgctgcctccgtgggtacagaagggcgcaataactttacctttaaaatcatattcctccagaaaggtatttacagccatgggcatgcttccccaccacacgggataccccagcagcaccacatcatactcttccatatgtaccacatgggaagcaagtgccggacgtgcgttctcctccatctctctggccgtctcttccagacaggtatcataatcttccgaataagatttttcagtttctatccggaacagatctccgcccgtataccgggcagccgtctctgccagcattcttgtgttgccgccgtaggagaaaaaagccaccaggacttttcctgtcccctcttccgcctgccgcccggctccgccttctgctttttccctgccgcaggaggacagggacagtgaagcagccagtaagcataagactgcggttataatttttttcacactttttccatcctttctgcgtatatttatgcgaatatttatacatatgtctattctatcataaatcatgggcttaactccagtgcaagcccatgattcactgctttttttcagtttcccaatagattttcttctgtttatcactcagggattcgataaaccgctttttatagagcaaaaattcctccagatccatcataatgtgatataagacagcccttccctcaaattcctctctagtcacgggcaggggtgcctcgtggaacgcattttctacctggcgtagccgttctatctgttttttcggaatatttttctcctccacatattttttcatgtaagtaatgtactctgcaatggtctctgcctggctgggcatagtacggatcttctgtatttcccagtgaaggctctgcagcatactgcactgcctggtccgcatctcaatataatgattgtaatactccgtgtgcggaagaaatgtatttctgtcatactcataagcccgctccatagaatgagagagatgttcctccagatgggcgatctcctcccatacatccgcctcattttccctctgcataagatagtctgccaacatttcaagaatatcctggagtctggcctctacataccgcatatcctgcaaaatctgcttttttctgctctggttgcgctgaaacagattcagcaggacagccactgttataccgataaaaacaagacagaattcattccatatggtagctgccccgaagtcatgcgtggtccagaaatgtgttccgataactgcattgacagacatggtattctgccatcccacaaacaagctgatccccaccaacaaaaatacaaacaccccatatgtgatccactccctgctcatatgactgaagatcatccaggccaggatcacggtggcaaaaaaggaaataagcctcacagcagaaagcctgagggtatcccatctcgtattgatcaaagtcagcagagcaataatacccgctgaacttgcaaaatccaggtgaaactgctctgccgcaagtatggcagtgcagcttcctatggctgttttcagggcaactgccaaatattttccggctttcattttcagcatctcaaaacctccaaagtcctgttatcagacaaagcatgccggacctgctccaaatgctcaaagaaacggctttaaatctctcataaaattttcttctgatctgacaaggcgttttgcaagcgccgtgctgtctgtggaagcatgagagtattggttcaaggccttactgattccctgtatccccatactgcagccctctgtcaaaagttttgcgatctgtcctctgtcatcttttatcatgagtttcacctcagtcgtcacccgtgaaaatgcagaggccataggactcggtgctttttcctcctcccctgactgttccagcagccgggaagtctccagctccagatcctgatgtttgcggatatattcatcagtcagatctctgagtttttcatctttgatatactctctgatctgcttcatgctgttaatacccattttgcagcctgagttacatttctctaaaagcttcttagtatgtgtttccacgttccatgcccttctttcttttttccttttagtatgggcatttgcagacatattatgcggtatcttccttctgaacctgtataaaaagttaatgttattgttcacagcaaatgatattagtccacaatatgctgaagcgtgtctgaaagcgtggtttttgaacagtaacaaatgaaaacttctgtcatattacgcgctttttttctgtaccaaaaactaattttatatgttatacttttgatatgatgtgtgaaaaaacatcggaataagaggttagggaaatatggaagataaatacgcactgctgatcgacgctgacaacgtctcagccaaatacatcaagccaattctggatgaactctccaaatacggaaatgttacatacaagagaatatacggtgactggaccagcacttataattccagttggaaggaagttctgctggaaaattccatcacaccgattcagcagttcagctatacacacggaaaaaacgcaacggactccgcaatgatcattgacgctatggacatgctgtataccagtgaattagaaggattctgcctggtttctagtgacagtgatttcacaaaactggcaagccgtttgagggaaagcggcaaaaatgtcatcggcatgggggaggacaagacaccttcctctttcagaaaagcctgtgatatttttacggtactggagcttctgcttgaagacaatgccatagaaaaagaggaaaagcccacgatccatgccatggaaaaaggcacgaagcaggacaatgccgacgtggtttccaagacacagatcgaggaagctgttgtcaagatcatcacagagaatcagaataacgataaaatcacaggcctgggtgaagtcggaagccgcctggtcaagttatatcctgactttgatgtgaggcggtacggatacagcctcctgtcaaaatttttggaatccttccccaaattaaaactgcagcaggaagggactcaggtatccgtcaccctctatgaggacaaaagcaaaaaagaaatgctggaggaatatgtgatacagcttgtaagaaatgcaggccgccagggtgttcctctgggtacactcagcaataagattcggaaccgttttggcgattttaaagtgcgggattacggtttttcccagttcaagcagtatatacagagttttccggaaatccgtatccgagaggaaggagaacagaactgggcagtttatgatgtataaatacccgttacttcacataaatatttatgcggatgcattgaacatgattttcaatgcacccgcatttttaaaacgcgtcaccgcttatgagattaaaatccgtttttagatattcctgcagtatatccaggcttttttctccgaatctgtccgcgaatttctcatcaactctttttaaaataatttccccatctgaaaaaacagtgcgcacatactcactgaaggttttgtaataatgaccgcagtgataatcccagccctttttcgcttcttttgagaccggcacactgttgtcaagcccggcattcctgaatacaagacgacaacagggtgcattgtgaagcacgcttttctgttcaaagaccaggtccggattaaatcctctgacaatgcccttgtctatttctctgcagtatacaagaccgcattcaacaagtcccatttcttgaaaggtatcatgccatacacagctgtaaacccgtgtctctgcatcaggatactccccggccatctccattttacccggcagggtggcatatatctccccatatgccatgtatgtattataatccagtggctttttgtcacgcatggctctcaaagccatacggtgtccccgctgctccgctgttttctggacagccttcctaaaacattccactccggccgggccttctgcttccttcatcttctggtaaaatgatccaatcaaaaatgcatgtaccttctcattaaagacaaagccttccgtcatattataattctcccctatcactaaaatgttcaaatgaggccagctctttgatggttattcgggtttgctcatgtctgtccggtgatggaggcatctcgtcactataacccactgcaagtatattgacaggctccagattctctggaatacagaattcttcccgcaacacatcaggtttgaaataacagatccagacactgccaagtcccaggtccgcggcctgcagcatcatatggtccgtgaggatggaggcatcaatgtcacaggtctgctttttgtcaaagggacgtacccatgctttgctgtggtccgcgcataccactatggcaagcggcgcatggtaaatatttgccgcttttgccaattttttaagtccttcctcctgccggatcaccaacagccggacaggctgcagatttgcggctgtaggcgccgcatgggcggcttccagtattttttctactttttcctgctccaccttctttccattgtaagagcggacagagtatctcctttttaccagttccgagaattccatattatccattcctttcttcttgcattttcctttggctatattataatcttaccactatttctaattttggcaataacgataacccttcaggcaggctggacagccgtaccttttctatttctgccagggaaaatttttgaatgaaaggaagatcaccggctcatccccaaagccgcaaccaagatacaaattcaaaacagctcatcccaaaaatcaagctggaattctctcatcttttccctcagcaaagacatctccttgtcattcagcactacggtttcccgcagttccttctctgtgcatgacaggatatccgtgacatactcaatcctgtgactcttcagtttatctgtcagttttctgccaagtcccatctcttccacatggtttggcattctgtttttaatttctttactttttctgaggaacttttttcgacctgtttcaatcataccctgctccctccggctttctgtccttcctacggctgttttctaactacataataagaattatgtggtaataaaagatcatcttctaaaggaatcttatgagaggtacagcagaatatgccgtcttttcttttgagcctgcttttatctgcctgcaggcttctttttgatatgtataagaattggaaatctcagataatttcattaccccgctgtccttaaaagacaaaccgagcatattttgttgacattttttgccatatgtattaaaatttctattaaccagatgcattaacgttcagattaactacataattcttattatgtagtgttaatgtctcgttttttatggaacgatcaaatccagttgttctatcattccctgaaatttcttcagcgtatctgctgtgtagatccttgtcacctcaagactgctgtgtcccagaacgtctgccagtgcagcaagattatttgttgtcttataaaaagaacgggcaaaaagatggcgcagattatgcgggaagacttttttcggtttgattcctgcctgctctgccaatagtttcatttctgtccatatattgcttctgtctttgggtttcccatttctggtgacaaaaataggacctgatttgattccctgctttccggcataacataaaagttttttccgcaggctctccggaatcaggacaatacgcgttttccctttattggacacttccagacgacctccctgaaggttctttactgtcagatacttcagttcgcttaccctgacaccggtagcacagattgactccagtatcagggcaagctggcttttctcctttctccttgctgtctctaccagtttttggtactctctctttgtcatttctttttccgaatccaaaaacatacgcttctgtactttataacttttcactttcagttccggaaaacacatataatctaaaaaacagttgactgccgccagcatggagttggcgctgctcactgcatactgctgtctcagccattctttgtactccaaaagacggattctgtgtacttgcctgtcattccccagatatcccaaaaatgttcttaaatctgtggaatatttcctgatggttgcctctgtcttctcctgtctgtataagtgacaggaaaattcttcgatcaattctgtcttcatggtaaaggtaatttctttctgcattggcaggcctcctgtgtatgatgttattccactattatagcttttgaggagaataacgcaatcgctgtaaaggaattaccagcatttaccaaataagtgttttgctgccggactgcagactgctttttatttttctacccggactgcaggcctatttcccctcactcattttcctcatccattctcgcatagacttctggtattgaagaggtgacatccccataatagaccgaaactgtctcaagaatgtgttttcactttcataaccacatttgacggaaatctcagccacactgtctgtaccggtttccaatagagaggctgcacggcagatccttaccatgttgatgtatttgttcaggttatgtccgcagcagcgcttgaattccttgctgatggtggacggatggagataaaagcgccggctcaaagtctccagtgtaagcctttcctggaaatgaaggtcaatatgatcctttatttccctcatggctgtatcggcggcagatatctcccccgcttctctttccatacgaagaactctgaacagaagcactgctgtctgggtcaggacacccctctgcatctgtgcccggtaatccttttctccctgctgttcctctgccagatcctgaagcagacctatcagtttagcaaaaatcttcggatctatatgcttataagattcgacgaaacgttctgcaggcggcgtggaaaataccttctgcaagtctttatccggtatcatccctcttagatatgcaggttttatcgtaagcccatatctctgatacggtgggtccgtgatcacgcttctgtggaattccatagccccaatgacaagaatatcatatggctccacatgatatttctttcctgctatgtaataatccgcctcccctgattccacaaaaagaatttcgcttgtgttgtggatatgagacattgtgagcctgtcataaccacatgttctcgagatattataacagtcctcacagatagcccgaaaatgttccgtctcctcataatcatttaccttgatctgcatcgctgcacctccggctgtttttattatttactatttgtaacagttcaccgctcaccgcttttatagctgtcgctgcttttatagctgccgctgcttttatagttgccgctgcttttacgcttcagtatatctcttttttgattttttgaaaatatctgacaaaaaaatggtgatttttcaccaaataataatcactattgattcaccaaaaatgttatatattataatgtaatatttactgctgcacagactgcgaaacacactcttaagtgtgcttttagccgcagcttaaaagacgcacctgtcaaacattaaaaatcatagcatcacctaacagtcaggcagggcattaaaaacacggaggtcatcatgaaagaaatcacaattcgggatattaaaacctttatcacagcgccgcagaatatcaatctggtagttgtcaaagtggaaacctcagaaccggaattatacggtatcggctgtgccacatttacctggagatgtaaaacaattgtcactgctgtggaagaatatttaaaacccatgctgcttggcaagtcggtccacaatattgaagacatctggcagtccatggtgggcagttcctactggcgcggcggtccggtactcaacaatgcactctccggtgttgacgaggcactctgggacataaaaggaaagcttgccaacatgcccctctacagtctgttcggcggcaagtgccgggagggaatcgctgtataccgccatgcggacggaaccaccatggaacaggtggaggataagatccatgaatatatggaacagggctaccgttacatccgatgccatctgggtctgtacggaggcaatgcaggcggcagtatgcagaccataacccggcctgaaaatgccccgtcaggtgcttattaccatccaaaactgtatatgcagagcgttgtaaaaatgtttgaacagatcagaaaagacttcggatgggacctggaaatcatgcatgatgtacatgaaaggctgcctctggcagatactctatgccttgccaaagatctggaaccctacaaattatttttcctggaggacgcgcttccgcccgaacaggccgattattttaagatcatacgggaacagaccactatccctctggcaatgggagagcttttcaccaatcctgtggagtggaagactcttgtacaaaaccagtggatcgactttatacgtgttcatgtcagtgatatcggaggtcttactccggccaaaaagctggcgcatttctgcgaagcctatggtgtgcgcactgcctggcacgggcctaacgacctgtcacctgtgggaatgactgcacagatgcatctggatctggcatgtacaaacttcggcatccaggagttcagtggttttaacgaggctgaaaaagcaattttccccggatgcccggaagtcataaacgggtatgcctgcttaagtgaccgtcccgggatcggaattgattttgatgagaaggaagcggctaaattcccttatacagacatggactttggctggcttttctcacgcctgccggacggtactgctgtccgcccgtaaagtatatctcaaaagcagttatgggtatcacaaagtccggtactttatgatacccataaggcagtggctcagtaacttaatagttacctttaatctctatttcttatcgtatggtttcacctctacagactttttatcaaagtcaataaaaagctgatacgcatatccgtcttcacttgtatcccagatctccacatatctcggtgacacttctataaggatttctgtatcctcgtggctgtatttgttgtagctctcccacagatattttttgtatccctcttcaaatcttcttcctggttcttccacaacaagtcctttgttcaaggctgttccctctacctggacgccgctccagcacagagctacattgggattttccagaagctgtttcgtctttctgaaattcttatctgttttaaaatagatcttatcatcgtaaaaaaggcagctcacattcctcaccataacatagtcgtcgaggctggacgccagtgccatgatcttactgtttcccagcatttcaaacatacgtcctacagcgtcctcatagctgatagatttgtccattgtaaatttcatttttgtttatccccctttatttttctacaatactcctgatcaccctgctcaatcttttgtacaacagaaatgtcaaaactgacgtcactccatacttgatcagattgaagggcaggattcctaaaattgccatggaaaaggcatttttcatagccggattcacagcactgcacatggatatgatctcatccatagtcatgccaaacagacgcacataaaacggaatgatcaggtacagatttgtaaaaattgccacaattcccaccagtaccgtgctgacacccatgccggctaatgccgtcttctttgtcttatgcctgtgatagatcagcagcgccggcataacatagcagaagctcaggataaaattctgcagctcgccggttcccagagaaaagctgccctgcatgacaagctgcagcagtatctttaccacaatgatcatgagtgccgcacccgggccgaacataaacccgcccagcatctccatcaatcccgacaagtcaaaggacataaagggcggcataaaaggaagcggaaatctgaaaagcatgagaacagcgctcactgcccccataaggccgataaatgctgtcttcttcacccgcattttcgtaccggttacggccctcattccatggtcaaaagctgcattggttgtttcgtttgtctggtccattgtcgtatcctccttcaaaaaaatgagcccgggacataagatatgctccgggcgtagtttcacagaaaatgtcttttctcatccggactataccgtcggtgctggaattcccctttttcgatcaaggagtcaccagctcagccgccaaagcgggtcatggactataccatcggtagggacttgcaccctgccacaaagacttcaatattcattttttgaaatcagaaatgtagtaaacatcgtctgttgtctttgattatataccatacttttccatatgtaaacaaaaatataagattgcctcaacgtgcatgatccaatgccttgaaaagagcatccagatcaacccttccgtactgtctttagtgtcacctcaacagcttcaaatttttaacaagctgaaattcagcgttcactcatatatccttttatttcatcagaagttaatttccgtacttctgtatgtggatattctttatattctccaactgtaaagaccggggacatttgtctacatttcttatctttattttttttcaggaaaatatgcaactcctcatcatccgcaaatattttataggatactctgcctttgctattctctatttcataaataccacacggcttttttgttgtatagtcagccgttcgtaaatagagttttgcaatttctaacgacctgaacggaaaattccacctttgtaatcctctatttttatcatattcaatacaaatacagcgcccacaggttccacatatatactgcgtgtggttttctaaacagtccaagggatttaataatggagtagctctattttcatcagagtaacattcttcacacattttacttttcgctccttttcaagctcaaatttgttcaccttaaaagccggaatttataacattgaaatcataggatttcatgatctattccgaccagctttgtatctcaataatatttccttcacaatcagccgcatatacaaagaccaccttcatattctgcctttaccagttctccaatctgtttaccgcctttttcaagcaatagcagcaatgtcttttcaacatcgtctacttcaaatgcaagatgcgctatcccacatttgttcaaggcctgcaggaattttctcaatatttccggtatgatccccctcctcccgaggatgactcgcttacttctgcctttttaaatcctgcgctgccacttccacgcttttgggaaatcacgattcttctcccggtacttctcccctgtaaaacacacaaaactttattgtattacagcaccgcctgctctgcttaacctctatactaaatataccataatctctttctgtcaggcaatggcagctctgaaagaattccggaaagtttgacttcggttactgtccgcagaccgctgtgccggaatgcgttttgcgcaggaaaacacttactgccggatatcagtaaaacccgtaccgctcagaaaaaaggctgctgactgtactgtttaaaaaaaccacactttaagcaatatattttttacgtatacgcatttatccccataagtataagcttttgtaagccattctccttttcctgcaacggtatatcttacgataaaaagcacacattttaccaaaataaagataccgaaaagaaaatattccctgctataatataacaataaatgatcagtggatctctgtcatccgcatgattgtaaccggcaaaagaaaagattaagtccagctaagaaatgtcaataggtaaaatgaaaaatgttaaaaaagttttttcaagcagttgacgaaaaaaagggtaactttaataagcccacccatgtggaaacttaaaaatttatgagaactggttaagctgcattccgtgccttgtcaggatgcgctgccagatactgcttacagtgttcctgaggagtgatgatctgaaacagcttattatcccggagcatggcaaaaatgatgttgcagattttatgcatgacagccccgacagccacgtttttcttcttgcttttgcatttgttggcatagtagctgtggataaccggatttactggtgtttttgtccctttatccaccttaaggttattgagcgctaccatatgcaggatacgcctggcaaggctggaacctctcttggacatgtggactttgtccccattgaatttgccggactgctttacagcaggatccagaccaaagtaggcataaagcttcttaggggaagaaaacaggtcaaaggagcccatttcagcgatcaggacaaccgcactgaggaagccgacaccccacagggactggagaaggaggatacggtcatagacgggtgttccttccagattattaacagccttatgcagttcttcgagtacgctgtccagatgctcttggtattcccggtaggttttgatatacagccggatccggagcgcgttacttggaagtgcacgtccgaaaacagcggcatcctttgcggcggtgcatatggaatcatacttggcaagggcatacttttccccaaagcgtgccgtgctgcggatgattttcacaagctcgtcttttggggcggcaagcatgtccgctgcaaggggataagcttccagaagttttaaggaagtctgcgttgtgatcttgctgaataccttcaggtatgcggggaaggacactttgagttcggcattaagcttcaacacgacggcggactgcagatccttgaaataatagtagtcacgcacgaggttgcgcaggtcaatgatagtgtcgtccgggacaatggaagtcttaagggagacatccagaccaaccttcgccgctttttttgaatcaaatttatcattatgcagtttccttacgttcatatttgtgctattcttagtgatgataggattaatgaccgagcagtcaaaccccttatcacgaaggaagtacaggagcgggatgtggtatatcccggtggactcaaggaagcagcggctttcgagagaatacatctcttgtgcttcctttatttttgtgacggcaagctcacgggactgtggatcagagtgaatgatcttaaatggtttaccagtgagaatgccattggggagcatgatggacatccatgtgaaatctgcgccgacatcaagcccgactgagaggtatgggatgctttcgagcatcttgagtgctttttgatagtgcattgttttatcctttccggcaggtatccatttccagaaggcggatacacaacctagcggcttatacaggtatagcctggggcttcccaaccagccaaaacataaatcaccaccgaatggactgacagactttctaagaggtttcaccagccgggaggccggttcccaaggaggaaacgtcaatgatcctgccttcagtgattatacctctatattttgtctggtgcatgaaggaaacctcagacatggtaaataatgttgccttataacttctgatggagggggaactcctccttacgttatatatagagatttattagattggactttgtaactattaaccagtagtcattcttgactacaccattattatactaggaggacacattatgacaaagtatacccttcaccccattcacattgacccggaaaagacctggctcatggactttgacgaatactacggtggaaaaaagacttattccaaatacctgatcgaaccgtacgggccttaccagcacaacgaattgctggacacggtttacgtggatcccaaccatgagatgtgttatcatgaacatacccgcggtgtagaaacctttcttgtggacggcggttctgtactgaccgagatctgcggcaaaaaagctgtctgcaccaaaggcgacattgtccatctggcagcctataccccacacaaattcacctggatcgacgcgggaaccatatggcgggagctgttccaggaaacccagatgggcgaagattgtattgccaacctgcgttttaaagaatataataaaactgaattcgacatggcaaaagacggccagagcactgacagtctctactatacttatacccctgtcacagagacagttcccaaagagcagatttatcagattcgtccctacaacagtggtctgtgtatctataaatttgagggatgcgaactgcggcagaaggttgcacgctgggagacaaagggacacaaagaaatctggcagctctgtatggagcctggtttccagttaagctggagtgcccaaaatcccttctacagtcttttcattgttcaggaaggttctgtggaggtacgcatagacggcatggatccatttactgccaaggagcgtgacgtgctgcatattcccacccacctctcaggtaagatcacagcccttgacaaagccgtactctttgattataactgtgaaggcttcgggcttcgggccattgaagagctgtacgccctatacgcggctgacccaaaaaaagtagagacggaagcggaagccattctttccaaacataaatgttatgtgcgcggccatcttataaaataagcagttgaaaacggccggaacaaggaaaaggattcctaggttccggccgttttatcatttaagatccagaggacaaaagggaggcggcaaaccgatatatgaaaatcttagtttttggaaatgctgacatgaagcccggctttatccgggccggaaaccaacatggacatcatgtactgtatacagacaggcttccatctgtggatgaagctctgagtttttctccggatgcggtgatcctgatgatccaaaggccggcatccctcattcaggactgcctggctgccatctatcatgcatgtactgcgcgcctttttctgttgtttgaactccacgagaacggtgtctgctgctttgtggaaaccacacagcgggacaacaggctccatgattttttcctcaccgcagccgaaggaaaacatgtggtgtcactgcaatatccccatcagagctggaagaatcgttttccggacgccttccgtcatttggagcgaagggaagccatgaaaatgatgctgtacggtgttaccgaggaagaatttgaaagctccagaaaacagtatgatctgcacattcattcatcggatttttatctgtttatgtgggagcttgacaaaaccgcactggtggattatccggtaaacaaatcgatccattatttccttcatgcactgcgtctggaggatttcctgctgatactggaagaaaaccagggaggagaaatcatcttttcagatatctcctttgcctatatccttgtgaatgcttcccgcccttcctgcgcccgtacaaggcggcagcaggcagaccatctggcactggaattttcaaaagccgccggacaaatctcctccaactgttttatcagtgacctgctgcagggaccggaggatatcagccggggacatcaggattttaaaaggacctgtgcctaccgttttttctgccgggaggcagtcgccatctccaatgattatatcaagacccatcagcgctggttcagcagagatgagatccagaacaccattgacgccattgaacattatctcagttttgatatcagcaatgaggagcttcctaaactgatccggcatctttatctcaagatcgtcaaacccagtatgagttataagctgtattatctggtaagcgaatccattctgaagtccctgaaagacgaactgtctgtcaaactgctgatggagaccattgacagcccctggcttgtactgaccacacaattaggcaccatagaggaaagctgtgcccgcgtgctggactgtatcaacaccctggcaaaacagcaggtaaagacacataatatcagcaacagggtggtccgccaggttctccggcatatagaagaacactatacgcagcccctgtctgtaagcgatattgccaaacgcctcaacgtaagcccgtcctatctgagccagtgttttaaggcagaaacaggtgtcagtataaaacactatctgactatgcgccgcatgcagcaggcaaagcagcttctgctcaccaccgatgagtctgtcagttccattgccatagctgtcggatatgatgactatcgtcagttttctaaaatgttcaaagtctataccggcgtgacgcctgtacaatgcaggaaaggggtaatgtgacaactgccccttacctgtcatctcctattaaaaaccatccgccttctgtgaaatacccttcatttgccagtctgacaggttctattttctctgttccgggcagtccgaacatgatataaatatcaagctcttctgtcatctcatcctttccaaagcggccatccggcacaaaatccacgtaaaattcccccttgtctttggcgtctgctgaaaaagaaagaggaagtatctgttgggaatcttctgactgaatcttcagaaaagcctccatatcagagggaatataagaaaaaccactgtttctcactatcccttccacggtaacctcctttccttttttcaatttctgcgggaaacgaactttctctacccatattcggtatcccaggtgtgacgtaatataatcataacctgacatatcttcaaaggtctgttctttccattggctgataactgcctggtccgcatagccgtttagatatgaggcatgcatcatagaaagttcttttaccgcattatttacatctgaaacctccgaaacataaggcatttccccgccgttaaaggaagtggaaactgtcttctcaagaaattcaaggctttccctcctgtccctctctccgtctttgtaagtgcccaggtctgtatccgatccgaacaggccgtcattataaattcccagacggtctgttttgagatcatatttcaaagcctgccggataaactggggctttcgcaccccgacaggaatacgtgcatccagattctccagcagatgttccagaaattctatctgaaatggtttttcttttgtgtcgtattccacatagtctgtagcatgccattctccccagggtcctaaaaagccggcctgcacgcccatgatctgctgtgcatgtctgtttaataccccgcagatctctccggtgtgtgacagtatatggctgcggggaggatcctcatattctcccttccaatcgtatgccgccctgaagatcacagaaacctcagcctcctctgctgccaaaagcgcctgttccaatgcgtccagaatttcagcggaaagctgctctttgttcgcctcctttttcagatccatagtcagaagtacaatcttaagtgcattattgttatctgcttctctccgcatagcatctgtatcatgaatatcatactgacagtaccagcctgtccgcggattggtaaaagcttcagaagtttcttcccctgtccatgtccgatacttatcccgtccctgatacagacataagatcagaatgatcagaagcagaacaaatagaatcattcttttcttcaatgcagcttcctttcctttaaatctgaggattcagtttcaaaaccacctcacagatcccggcatatatcctgggacacagacggaatatcatgacagcaatccggtcagcagcgttttctgctctgcggatacatctgttatatttgcggtaatactttttatgttcctgctccagatgtgtcagaagtttttttctgttgggcatgtatttccacacacggtaccaggatatttgaacattcagcagataccgcttcctggcatatgccgtctcccttctgtcaccttttttctcaaaatattccgcgcactctctcagagctgccagcttatccaaacgcctttcattatagccttcggacatgatactgccctccctctggcgatagcagtaatatttcctggtcgtgactgccacatgacgggattcatacaaaatcttatatgtcacaaattcatcctcattgatccgcccctcaggatagacaagcagttccttccactttctgtgatacagctttccccacgccacgatcataccgcgttcgtttttctccacgatcctggctgccgcagcatgtccgcttatgcagtattccatcacctgttcctttttctctttttcttcagtgacggtaccatcctcatgctcccaggccagacgatacccgcatacggaaacatccgccttatattttatgatattatgatacaaacattccaaataccggggagccacatagtcatcactgtccagataggttaagtattctccatccgcatatgcggtccccgtattgcgggctgccgacagtcctccgtttttctgatggatgacccgtatgttatcctgctccgcatacatatcacacagatcaccgctcccgtctaaggagccgtcatccaccagtatgatctcataatccgagaatgtctgtcccagtaaagaccctatgcattttggaagatacggctttacattatagactggaacgataacactgattttacatttcataatgatttcctcttattttactcggcttttaatatatagtttcatgacaggatatgccagcaggaacatgaccgccagtatctcctgtcttattttcccgcccagcatccaaaggcatgagctgtaaaaaaagcgttcctcccacaccggaaggcttgacaacgcagcaaagctgtttttatctctcatcattttaaaaaaggacggttcctttaaaaatactctgactctgcctttaagccttttcaacgaaattccttcatgaggaatatttctcaccagtgcccagcagaacatacgcatggcaagagaaacaaaaagctccctgttctcatcctcttttccctcttctctgagaaaacgcgaatagaaagaaagggtccttacacttttttccgcgatcttcgtgtccggccttctggtggtggacgcccccgttacgtcatactggtacacacatacagggcacagataatagaccggatctttgcagaaaaccttcagattaaatagggtgtcttccatgtatattcttctgacatcatcaaagaaaagcccgttttcatccagaaattcccttttgtacagtttattccacacatagccgaaaaggcttgaagtcttaaccttgtgatatctggatatttcatcccggcttccctttttccccagataaccttccggcagatctttgcccacttcctcttcgcctctgctgtcaatcctcttataggaaccacagacaagatcgcatttcccggcttcggctttcttaagcaatatgcggattccgctccactccaccttgtcgtctgcatcggcaaaaaacagatattttccctgcgctctcttcatcccgtaatttcttgcttttccctgtccctggtttttggtgtgatatactgacaatcttggttctctgtctgcaagctcatcacaaagccttcccgtttcatctgtagatccatcgtccacaacgatcacctcgaagcagatatccctctcccgcaaaatagaggacagcatttttttaatacaggctgccccgttatataccgggataatgaaactgatctcagtcctgttcatcttcatccctcctctataccggcatccccagtctctgctttatggcacgaagcagtacaaagtacaaatatactatttttcttctgactttaccggcattgttttgcagacttcccacctcttcattttcacgtaaaagctctgcaaaagccgcatccattgtctgccggcttttcaaacagacgatactgtttcttttaaaaattccctgtatttcctccgtcactttttcccggttgtcaaactccctgtccagaaatacatagcagctgttattcttcttcagcctttttatatagaccggagagcagaatacgctcaatttcctatgtaacggggcttctcttctctttcctctgaataccagacaatacatagggtgctcctcgtaatacttatgagccattttcagcagatccgcttctgccattccccgttttctgaaaaacaaatagtcccaggtaaatctgcgttttttcgcaatgtggtagattctcagtctcctgtcaaagcaccaggccagcgcagtgcggtgggaaccgtccagtgccgcataatcctcatccaccggtatgggatcccccggaatctcctgcccttcccggaacagccggtataaactatgcagtgtttccacatattttcccattccatcctttgcctggttaccggcttccaccactctgccgccgcagaaaacttctatatgccgcttgtaaagagccagagcgtccgggatatctttttccttcttcagcgcttcaatatatatgatcttggcatttaagtcaaatcttaaaggattccacagcacacccgcgtccacagtctcttcttccgccagttcatgccccttaaggcgaagagaactgcatacatagggatatttatgaaaaacctcttttatcactccctggtattggcctgctgcctttttattgatcttttcccatgtttcttccctgcatttttccaccaaatgcacagaattcttctgcattttaaaagtgtttcttaactcctgctttatcacctggatctggggcagctttttcccttccagtttataaaatacaaccggatacccctccgcgtaacaccaggaagccttattttttacattcttccatttatccgcccagggctccctgtgataaacagagtaaataaactccgtgaattccgagagagtcatacgcatggatatctttttttcgtatacaggaatcttccactgttccagaagatgttctgccttcctctgcccctcctcggaagcactggaaggccatagtatcagaacggaatacttcttttcccctttcatagctgtttttcccccaacttttttataatctttgataccacagctccaaacagaaaaaagcacgccaaagaaagcagcagacacagcatgccctttatgcagagccaaaaccaggaatgagcaggcatagcttgcaatggaatgccaacgatcctcaaaatcacataagtcaatcctccgctgacgatctgataaacagcctccggtttccaggattttccgaaatagcggtaaaccatatatggctcataaaaataaagagttatcaccgatgagactgccgttgccgtcaaaattcccataaggccgtatacagctcccaggatataggacaggacaagattgagcagtccctttcccaaaacaatatatcccaccttctgaaacagtcccgccgattgtctgtaagctgccgtagtctgccggattccggtcaaatacaggttcagggcaacaatagccgggaccttcatatccagcaaaacctctgctcccatccaaagactgataaaatcctgcaccagccaataaaatcctatgactgttatcccattcaccataatattgactgcagagagctttaaaaaatcactgtattgcttatcccggccatccaggctgacagaatgtcctattttcgccaaaatagaatcaaaaaagcttgagatcatgctctggatccccatgctcacaaacatataattagaataacagcctgctgtggctgtgctgagcagatctgagatcacaatactatccgtactgttcaccagtacatttcctgccctgtaaatgatcaggtcttttacatttttccggatttctttctgttctgccgtacccggcattccttcttcctgcagaagataagaatacctgcgtttgatatagctgtgaagtataaagtatgtgatgatatttttaaccagcacgcagagcaaaaacaacgagtaattataagctgtttttaacacaaaaacctgaaacaccagcgccgcgccgtccactatgctcataaccaggcagcagatatatctcttctgatccgccatgatataataatattccagaaataggcggttatagataagcacagacccaagatagaggaaataagtgcctgtgatctccatgactctgatatccgcatgtacaactaccagtacaagaaaaacggctgcacttcctatactcattaccgccacagtaagaatacggtagatcctcctgtaatactgatagatctccgcctgttccttccgctttccaagtgccagcgggcggtacaggctgtacatcatagcggtgccgatccccataaaggcaaatgtgaaaatgtcgcagaaatttccaaatacggtctgcagtcccagatattccacacccagatatgttctgaccgcatatttggaaaccatattgataagcagagaaagaacctgatgaaacactcctatgatcacattactctgcagtctgctgtcccctccactcactgtcacgcctccttttcacattttataagatactcaagcctgtttttgatacacgatcctgcctttttgggaagacttcatcgtatctatgattttatagtggcagaatatatgggcctcaaaattcttttccagataccggatcctgaagtagctggcagtaaaaccacagagcattccgaaaaaagctcccatcccgtaaaaagccaccggaagattcttggaaacaagtgttcccagaactgtacccgcaaaatatgccagagctgacagcagcgttcccttggtatcgtcaaaataatacagatataccagattcccatacaacaggaagattcccagataactcaccgccagaacaggatagatctccatgatcatccctgaaaagcctatataagggccaaatatcagcagcaccaggaaaatgacagaggtaattgccaactgcataccaaagacctgtccaatctgctgtgataaggtacgaaacatgatttttttgtttttctgtatggctttgtaggttcctccgataatggattccatataatcctgataggcctcgtgaaacctggtctccgccaccactgtaaaaagaatcatagtggaaatattggtgaacatagcgagacaggaagccatatcatatgactgatggctgtgatatgtctgtgctacggtcaaccgctgctgtgttgtccagaatataaaattgtggacatacagacccagcatataaagcaactgcgtcagccatatcttcccatggtgaaccagataccaaaggcattccgtataattctggctcactgtcctgaaatatctcttgatataggagaactccagcacagcgatggtcagaaaccccgctgccatcccgtacagtatggaatgtatcctgtccgctctcaagacaaaccggaataccagggctgtcaacactaccaccagcatacccaccagaaaaaatatggctattatcttataatcctttgttgcgtgcagataggtgacagaaaaaaacaacaggacagatgacatccaaaacacatatgccgccagtatgaacggcagatcaatgccccctctgaaatatagactcaacatcacaggtatagatattccggttcccagaattcccagtatgagtatacctgtataaaatgagggcagaatgttggcatattcgtccatatagaatttatctgccagatatctggagaacaccgcattgaacggggctgtcagtataatagaaaatataaacacatacaaaattgtggaggataaaagctcccttgtcataaaagaaaccttcatcatgttcagggcaaggtacaaaaacaataaggtgacgatcaccacaactgttggcccgatcgtgacaaccgaactgtatatgccccctgccactgctctggctattccttctttacggtatatttttttaagttcaaatcctattccagccatattatttcaccttttctttttctgccatcctctgatataactgataatactgttcaaaaatatttttttcgtcataaaaggtacagactctgcggtagccggtttcgcccattctcttccgtttttccgggctgccggccaaatccagaattgcattggcgatcttggaagtgttcataacaggtgcaatatatcccgcatctccccagtcgtcaaattctccctggatcaatccccggcagtttcccacattggtggctatgaatggttttttagccgcaaatccttccaaaattgccagaggctggccttcacttaaactggtcagcagtaaaatatccatttttccgatataatccttaatatttacaataccggtaaattccacgtcctgtatattcaggtcagccaccattttgcggcactcctgtgcgtattcctcagactcttccagagaccccatgatccagagcttcagtctcggctctttgctttttgcaaggccaaaagctccgatcatggtttttacatctttaatcggcgttaccctcagcactgcacccacatggataaagggatcttcctcctgtttttggggaatattctcaaacttgtgggaatccacaccatttggtatcaccattgtcttgttctcactgcatccaagctcgatctggaactgtctggcctcctcaaataaggcaaccacctgatccgcgaaatcatagcagcacattcccacttttctgaactgcatgatccacagatccttatatatccccttcacccagtctgctttaatgatctcctcctcccgttcccgggtgtagatcccatgctcagacataataaaaggtttgtcgtagagatatctctgcatggctccccagatacctgcgtatccgctggaggctgagtgatacagatctgcttctgtagtccttgatttcagcatggtaaacagcggcaggtacatggaccgcatagtccagagaaagtccgtaaaaggaatccttgcaaaatgctctttatagtaagccagaaccatgctcagaaaatcttctcctgacaaaagcgcattcagggacacctccttctccgcaaaaaagcggatgatggtcttccagtccacctctttgccgaacagaagtccttcaaaagcttcgtattcctcagaggtcattttcagtctcttttggcgcctgttgctcatataatcatcatccagcagataaacttcctggatttccagacagttatccgggatttgatatttaaagctcctggtctcctccctcttggctgctatactctgtacgataaactccgtatccttcatatacagcataagctgctgtatccagttggacatgccgccatttacatagggatatgccccttccacgatcagacaaactctcattccatcacttcctgtttccagtcaatcttcacctgactgttatttgcacggatcatataaagctcctcgccgatttttgttatctcgccgccttctgtgcccgtgatcttattgggtgtctgcatataaaaatatgcctctttctcaaagtttccgatatctattctgactccgtcactgctgtaggtatactttggctctatagccagcagattttcaattctcccggcagcttcgctgagcgttaccctgtcaatccatggataatatttcttatgtgtacccatggcagtttccatgatcttgcagtattccatccattccagcttttcatcctcatcttcatcctccaggatctcaggaatgtctataagcccggttatcattccaagcccccgcagacctccgtccacaaactgcctctcctggagataatcagacatattgtcaaggagcagcggcacattaagtctttggtccttaccatcccggaactgaaaatcctcagtccattcaaccgcccggctgctgctgtctgcaatctccatagttccgtccaagagaatacgactgatctctcctttggccgcctctatttcctgacagaaataaaccagttccccttctttttcaagggcatcacttccgtaatcaggagtaaagtaagaaaaacggataccatagatatctgagcaccgctttaattccggataaaacaaatccctctgaacgcctcttgcatcacgggaatagcgtttttccaatatatctgatcttatatttgaaacataaggcatgccttttacagccatgcagtatgcattcaccacaggatagatataggtttccgacaggtcacagaaaatcatactgagcattgcgtatcccaaaggagtctcggcaagctgtccattgctcacatacacaaagccgtcgcctttctctcccacatagctccaaaacagaggcggcaggtcttcattctccacatcctcatcttccaaaagcgcagaaatatatatctgggtctgtttctttaactctatctccctggccggtatatgagaatcttcactctctgagatcgtgccgagaagcaggttctgggacgttctcatggcctcataaacagtttctttccccagccggtatatccccaaaagatttctgagtcttctgctcttgagacttgtatcatcgggaaataccgcaaaaaatacatgttttccctttttcacctgttcttccagccactccgtatcctgttctgttattttttctgttgttatgatcaggagctttaattccggaagttccctgtctctcagattgtctattgactgcacactgccaaggctctctttcataactgtcatctgcaggccaatcaattcccgcaaatctggattctcactgccaatgacacaggcgtgggcgcgctccagttcactgtcctgtaccgcatcttccgcttttgctgttgctgtgcttggcggcttctccttcttattctctgcccacatcatgattttagacaggttagccagcagcagaaatgcagacagcaaaagaaagaggatgagaacaatatatacataggtatatcttttcagttggtttttcgtctgaaatttttttctgtccacaaaatctcccttactttcttttataacgaataaacgcattaaatgtgctcagacacatgagtatcatatatttcacagcatgggcagcccctgaatgcatggcaattccttctgtgcggatatgcataatagcaggtatctctgttatatggtatccccgaagaagcatttgaagtatcatgttgagatccgggtatttaatatcaaaattgctgtatgaagcataacaggaaaaggctctgcggttcagtccctgcagtccgcttgtggggtcagtcagggtatatcccgtcagtctgcggatcacaaaacggaacatacggatcgctatcagcctgatcttagagacagggtatgtctggcttgcagataaaaaacgggagcctatgacaatgtccggctgtctctcctgactggcagtcagttttttgtaaatccgttctagatttctcacatcatgctgtccgtctgcatccatctgcagcagatattcatatccgtgctctaccgcgtatttataacctgtctgcagcgcagctccgtatcccatattataaacctgccttatcactgtaaccttacacgccaaggcctctccataggtattgtcagaagacccatcgtcgatcaccaccacgtccagccagtgatctgtattgatctcctgtattttacgcagcacatttccgatatttgcctgctcattataggcaggtatcaccaaaaccactttatgatccatttccatcatcctcctctgccggtatactttttgtatagtccactgcaagattcagcagaaaatattcatcctgctgtattttataaacggtgacacagtcatcctcatagtaaacagaaatctcattgggaaagaccaccttcatctgttccatccagtaatacagcttagacatgacgatctgccgctgaaaataatacagtctgtcccttcctttgctgccctccttgggaatatccaaatcctgccgtgccagttcaggagatacgggtactgtgaaatctataacattgctgcggtctatctttctttttgaatcgtaatactgtgtcacatttttttctgttaccacaaaaatgtattttgtcgggatgaaaatctttcgtttattcttttccagcttatccaaaagatccagtatttcataatggtatccgtccctcgatacagcggaaaggtcattggtagtggacataaccgtccaggtttcctttttataattatcgatcaaatccaggcagacacgcatatctgcctctgtcacggtcatttcaaaatatctcccttttttaactgccccatggctgcaaatcgcacccatgactgcacatcccgccgctaaaaccagataatccgctattttcttttgtacgccgcatcttatcagacaatcgtagcaaaactgccctggcatagccaaaagcggaaccgtaaatacagcgaggaaggtggctgcccggtacatctccaccaacacgggcgctcccacaagatagcaggaatgcaatgcgaataatgcagcccaggccaatgccagaaatacataaatgaggtactgccacttctcttttgcgaatatgatcccgaacagtccatacagcagagcaaacgcattcaaagccagaatgatctttgcataaaacatactgctgacagtctttgaggcaagcatctcaagtacggtccgcaccgcatcctctggggaatgtaccttgctcagatcaaattccggctcatcctcatcgtccttctcctccccggaagcattctgggatgccttctctgtttcctcctcatactgctgctccagtgtctccattccataatccccctgcataatggaaagtgcccagtttatggaacgctcaaatggataccccaaaagatatccgcatccgtaaggaagcattgataaaatgagagccaggattccccctgcaatcactttgaaaagcatcttatctctcagcatccgcacacagaacacaataccaaagcaaacgcacaggatccctgctatgatagccacatagaaatgtgcctgaaagcaccagaaaaccgacagaataaacatccacagagacgtattttctttttcttttacataggagatcaaccccagaagcatcagcattaaagccacaagcccgaattccatgggaaaggaaaactgaaagcggaaataggttacagtggtaaaaatgtcagagacagcaaaaactgcccaggctccaagagccgcgaatctggatcttatcaggcttctcaacagtatatagacagacagaaatatcataaaggttgaaaatacagcgatgttcaaatatgtacggactgccgagatacccaaaaccgtagaaataactcctgttaaaaagtgaagcccaaagggatacatacctaccggaaaaatattattgtccaaaagggactgtatccagtataaatgagtctcctcatccgtgtgcccataggctgcggatgtaaatttatacattccgaaaaaatacagtacaaaggccatgaccaggaaaaccagcgccagttccaacagattccccttaatattctctctgtaataattctgtacacggtctttccctatcataaaaaggtcacgcctcagttttctcctgccgtagacgccggcggcaatatctttgatattcttcctgcgttcccttaaaaaagctgctgcagacttacgccttaccaaaagattcaggagcagagggatcagcaccataaagatcaaaacagaccatctgtaaaaacatttcatataggccagcaaataacctatgctgataagatatacattgcctattgtctgataaaaacagatacggtacagccaccctttttctctgacaaaggtgtgaaaacataacgacggcagaaagataacaaccaaagcgtatccggccgcgaattctattatattggttatattagctgcgatcattttctacctctcacttatgttcataaaagcgtaaccactccaggacttccccgtccagtgtcagggacgatttcttcacttcttccagaagtgcaaagaatttctcacgctctccttttttcatgtaatatttcaggcagattttcaatgcctctaaatctttcagtgcgtatttttccgcagtctgcacaagcagttcctctttgcctggttctcctagtttagaccacagcgtcattgcccgggccagcatagttcctgtgatcagagaactctctttttcctccaggcggttaaaggctccttccagacgttccagataagtacggcgttccggcacactgaaaatatcatattgcagcatgttcagtagatactctgcataccggaccaaggactcttcttttctgtcttcacagtttttcctcagacgttcttcctgttctttataccggctgaccgtatcggagataaaggaagatgcaaaatgggaaatttccatatcctcatcttctaccgcctgccgtatcacttccagagatttctcgtaatcctcttttttcagcaggtcaatgaatacctgacgcttatcttttttatcagagacaagtaaagcctcctccacagggacctgatcactgctttttcctatgtccggcgcatttactgtttttgttctttgtttattaaaactcagctcactgctgtccaataaaaaatctcttttacggaacaaaagcacattgatcccttctgaaatggccagaaatacagcgcctactacggggacagccagcataaacaatccggcagtaagtcctctctgccatttcttccttcccatttgtatcaatacataaatcagcgcagtgactgcatttacgatcaaaagtataatcagccatttcataatccacatctattccttccattcaactatctgactggacagcccggcctgctctatgcgtgcaattacatactgggcatcttctgttttggtatttgtcagcagtatccacagcgttccctcatgcagacctaggacatctgtatcacgtatatatctgcgcacctgttcaaaaatggaagcgtcttttatccctgtctccaggatcacatactccagaagcccctgattccgcccctcctggcacgtctgaatggccttcgccattgctgtttcattcagcacctctgttccttcaagacaggcatcccgaaagatggactgttcatacaggattgcccgggtgactgccttctcgatcagcctgcacagcagtgccaccatattggtatagtagagattgatcctattcaggtcttccacccatatcataataaccgcttcaatttcctcaccgctgtacgtggctcctgcatagaccggataatccgggttcatttcccggtttacaaaaacttctttctttgagatggttcggtaaagactgctgctgtggtctatacagagagaacgtccaaggccggctgctttttctgaacctgaagcattcagcctgtaatatcccgactttttgcttgaaacataaatggatacatcttttgtgtccatcatgttcatgataaccttaatggccccgaacataacctttctggactccatgaagtcaagctgggcagtaatttcgtacagcttcgccatactgtttttataattgaccagtctctcctcatatatctgtttgacataggcattgctgtcattgatcttttcaatatccttcaattcactggacagatatgtattttcatcggaaaggtcattattctttctcttatatttgtcccgcataaaaccggtcaaaacacctaccacaacgatttccagaatacctacaaatacactgtaatcattggaaaacacctggattccgctgctgctgaccagtacggcgatctgaaacacagaagacagcgcagaggcaaaaagcccatgggctatgccataggtcgctgcaatgatgacaacataaatcaaataaagattcagactgtctttcacccatgtgtgggaaagccattgggacaacaggacaataaggataaaaaggcccactgtctccagcgcagggatcattactttctcccaggcagattcctttagctgctttttcttattttcttttatattcttctgtctgcattgatgataaaggtgttccagtcctgtttccattggatattttattctgacaagatcatatccgcacaatttatgatccaattccagcctgtgcggtacctcctccgcctcaagactgcatggctcccattccaccggactgccgcttttttcagagatttttttcagagtatcagcgatctgttcttctttgtattcttcccctctgatccagtacattgactctgtcttctcccggaaaacgcactgcatcatacattctaccgcgtcatccatatagagaatcctgtgatagattcccggataatatgtgcctttttgattctccacacactctctgaccattctctgacagacatcaaagcggtcataatccagtttcccatatatttcagggaaccgtaaaacactcatctcaaaggattcctctgcaaattcgcttaacagccgttctgcctgaagaaatgtctttaatctcagactccctgccaaaggcagtgtctctttcacaatctcctccctgccgttctgctcatagacatccagtgtagatgcatagatgatctgcctgactcccgcatgcttggcagccagtataagattgctgagacctgatatgtattccacagactgcttctgttcatctctccagctatacagaggatcaaaacaccccataacgatcataatgtccggtctcacattattgaaaattcgggggatactttcactgccatatggaaaagcataagtctggaaagcagaattcttctgtgtctcctgacttcctgtgatgagatagatttcctgcttttctttcttcagacgctcgatcagacggttacagatatctccgtaattactgcatatcaatattttcataaacttcccattccttttgttgttcccgatttatgattctttggcttctctttgttccttttcatatttcagcaggctgacctgcatggataattctgttacctctgctttcagtatggagatttccttggcatgattaaagcctatgaataaaagcagcacgatcagaaaaaaaatcaggattgccggtgcccaccaaacccccagtatattggccatccatgccagcacgccggggaacagccccataaagatgatacctatggcccctataaaccaaaaaatagactgcacttcattcatttttttctgttttgccgtcctggtgaccatacacatcataaaaactcccaccaatacagcaaatatttttaaaatccaacccatatgtctccgcctccctgcatacttttcgtattaattgtcccagataagcaaccggtgcttcacctgcatgctttatctcttcctgcacttttgcttgttaaatgttaatgaatactaatacttgctcaattttaaaatatctgattctgtgagcattttcaacaggttggcttgtttttgcattttctggcctgttttagcgtttagctaaattttctccggaaattgttgacacagtgataatatttctgcgataatgattaacgaatttatattttacaatacagaaagagggaatatattatgcgatttgcaattgttgacgaccttgcattttgcagggacgagatcaaaaaaaatcttttccgatatatcggagaaaattttgcaggtgaacaccctcagattgatgaatttgacagcggagaattatttctggagaatttttctccggaaatatatgatatgatttttatagatcagtatatgaatggaatctcaggcatagacactgccaaaaagattcgtgagtccgacaatctggttgcacttgtctttatcaccaccagccgtgaccacgccctggacagctacgaggtcagggccagcggttatctggtgaagccttataaattcaaagatttttcaagaactatggaattggtgaacatgataaaactccgaaatgcacgttttatcagtattggcggcagaaaaatactcctcagagaaatcctgtggtgtgaccgcgatgaacattatgtacagatacataccgacagacagggaatcctgcggctgcgcctctcttttgcagaactagagcagctccttttgccatatatccagtttctgtcctgctaccgcggctgtatggtcaatatggaccgcgcagtgaagatacataacctgaattttatcatggacaccggggaagctgttcccttccgaaaacgagaccggggaaacattgagaaacagttcaatagttacctatttcaacgagagagagaagaatggttgttttaggcgggtggaatcactgatgcggttttggtttttgacagtttgaatacatcgtttgttataaccgaatgtgtaatgacagagctgttaagctttggggtataaataactccttttcggtaagaatccagtatggtgatccttatcaaaaaggagtatttttttctgcagaatagggtgaagattccttgtcttacccagggtaatgttcgtattgatttctatgctcatgaatttttgtgaaaatatcatttcttgtggcaatcaccattttaacttccctttggtaacttatttttatagttttatatgtgtaggtttttaaattcagctttttatagtaaattgcgtgccgatagaatagggctatgaaactgtgactctgtaaaggaagcggctttgaatgtccggaaatattctatttaatttttgtaatgcaaattttcgagtttatatggttagaacgttcaaatagatatatggtggacaatggttagacagttgtgatctacacttgtgcatgggaggtgatgttcgtattacatacaaataatatcctttttacttctttcagccgatacttttgcaagagaagtgacaggtgtcaatggggaacgtaaactgctgttgctgatttcaatccacacttccgcaagggaagtgacctgtggtcggcttatatgtgcattcatatccacctatttcaatccacacttccgcaagggaagtgactgccggtatgaaaaacaagtatcggaaaaagaatgatttcaatccacacttccgcaagggaagtgacatgaaaatgttatagaaaatatatatgatttattcaatttcaatccacacttccgcaagggaagtgactccgtcctccggtatctgtgcaagttggtccctatttcaatccacacttccgcaagggaagtgacatcttgctgagtttatgaggcttgtattcctcgaatttcaatccacacttccgcaagggaagtgactatagaaaaggaaatgggtacggaatcctttaagatttcaatccacacttccgcaagggaagtgactcccgtgtacaatccgagggcaccgcgcaagtacaatttcaatccacacttccgcaagggaagtgaccttctgtccatagaacccggatgccaactctaatttcaatccacacttccgcaagggaagtgaccttgtccgcaaaatcattgattttattgagaatggatttcaatccacacttccgcaagggaagtgaccaaattcatccacagcacactgtcctggccattatttcaatccacacttccgcaagggaagtgactgtgattgcaataggtgttgtacgtggacatacaaaatttcaatccacacttccgcaagggaagtgacgtcccagtaattagataagaggtgttcgcatttcgatttcaatccacacttccgcaagggaagtgacctttgcctcttcatatccattcagtcttttcattatttcaatccacacttccgcaagggaagtgacttaaacatgtcttcggcatcaaaacccaccttctatttcaatccacacttccgcaagggaagtgactaaaaagcgcgagtgagaggactgggtttgatctgatttcaatccacacttccgcaagggaagtgacacacaatcaaggtggacgcaagcgactacgacggatttcaatccacacttccgcaagggaagtgacacatcttcttataatgctgacttgaagacattaatttcaatccacacttccgcaagggaagtgactagagacgataaccaattttctaataccaatacttatttcaatccacacttccgcaagggaagtgactatctttttaagcagtcccttaaacccaatctcgatttcaatccacacttccgcaagggaagtgacgggcagcagagtctgttgtctcagctataacagatatttcaatccacacttccgcaagggaagtgacttattgctctggatggagaaagagaatttaagcaatttcaatccacacttccgcaagggaagtgacacaatcaaaaattccctgcttgcatccgctgaaatttcaatccacacttccgcaagggaagtgacgcggaaggccatacggtgtacgactgtacagatatttcaatccacacttccgcaagggaagtgactggaaagcctgggctttgatattaccaagatcacgatttcaatccacacttccgcaagggaagtgaccggtcgaccgccagcgtataacttgtgatcatcaatatttcaatccacacttccgcaagggaagtgacacttcgttatgtcatcatagatgtatatctgatatttcaatccacacttccgcaagggaagtgacgagaagagaactcccggacagtcgcacagaatgagaatttcaatccacacttccgcaagggaagtgacggcgtaatgacgaatctaggcgtaccattaacaatttcaatccacacttccgcaagggaagtgacttgctctcccttttgattcatcccggcgttctcctatttcaatccacacttccgcaagggaagtgaccatggagtatacggaaccgaaaaaatgagggaaaatttcaatccacacttccgcaagggaagtgacggacccagaagaacttttatctcttgcaagtatgatttcaatccacacttccgcaagggaagtgactctgggcagatatgtaatccaccaccagttcagggtatttcaatccacacttccgcaagggaagtgacgcatataagtttttaagcttcccgggattgtccctatttcaatccacacttccgcaagggaagtgacaaaatgaaatgcaggaagtcatcctgccaatgatgatttcaatccacacttccgcaagggaagtgacaatacatattgattttaaaaggaggtaacaacatatttcaatccacacttccgcaagggaagtgacatcaggccgccagcatttttagattctggttcagcacatttcaatccacacttccgcaagggaagtgaccagggtatagcggcttatgacaaatactgtgaaatttcaatccacacttccgcaagggaagtgaccaatgtctcctgctatatacttcgcatggatcatatttcaatccacacttccgcaagggaagtgacgccggtgtatggcagccagtccatgatttctttgtatttcaatccacacttccgcaagggaagtgacggcagcaggccggaacataaaggggataacgattatttcaatccacacttccgcaagggaagtgacgcggcaggtgtacaaaagattgcggactttttcggatttcaatccacacttccgcaagggaagtgactggaccggccgggcaaccgtcaagagctttgaccatttcaatccacacttccgcaagggaagtgacgccatgtagtcatccaaaaggtcggaaaaaacgatttcaatccacacttccgcaagggaagtgacacaagcgagccacgaccgatgccgacggatttatatttcaatccacacttccgcaagggaagtgacccgttgctgactattacaaagtcatggaaactctgatttcaatccacacttccgcaagggaagtgactccgtgtttgtggcttcgcccatttctccaatgatttcaatccacacttccgcaagggaagtgacacaggcctgcagccggtacggttcaaggtagtaagtatttcaatccacacttccgcaagggaagtgacggaaaaggagctgagaaaaaggctatgaccaagatttcaatccacacttccgcaagggaagtgactgtgattctattatttttaggaaaggatggtattatttcaatccacacttccgcaagggaagtgacggaacatacagaaaacgatggtctgggaaattgaatttcaatccacacttccgcaagggaagtgactctaggacgtatgaatgatttaggttacatagataatttcaatccacacttccgcaagggaagtgactttgagcgtgtaccacttatctgtctctaacgcaatttcaatccacacttccgcaagggaagtgacatattctgtcagcggtccctcatccggcacagaatttcaatccacacttccgcaagggaagtgacaagaaaagactgcgtagcggtattggattagagaatttcaatccacacttccgcaagggaagtgacccaaggagccatctgatccggcaacctcatctgtgatttcaatccacacttccgcaagggaagtgactaattgcacctgcaccaggccatccattgagtctatttcaatccacacttccgcaagggaagtgacggccagggagcctgtatataaagtatagaggtagatttcaatccacacttccgcaagggaagtgacttacctcatctctttctttttttgcaataaaataatttcaatccacacttccgcaagggaagtgacttttatcagctgctctattccttgctttatataatttcaatccacacttccgcaagggaagtgacccaaatcccagatcctggccactaccttattcgatttcaatccacacttccgcaagggaagtgacagcaaaaatgcacaatatcactatataaatattgtatctttccactaaattctaacctttttctctaaaaaatgcaaccttaagttgaaatataatccataaattcgccataactacacatttttatacttttttcaggtgcgagtctccctggaaaactatgttcactccatattcgcacctgacatttataaaactcttataactccgagtccctatcctattaccttcaatatgaactgccgcaataatgaagtccttattgaagtccatggaaacaccaccgaataatgggctgataatttagactcattctattctgcttaaaaatgataaataagcaatttccaaatatactttatttaaatacgtaaactacgattttaaactatcctttcattccttcctctatttatcataagaaatttcatagtgtccaaagccgattgtagcccccttgccaacacgcaaaaatttaccagcttccagaatcggcacaaaacttgataaatctccttcataaagcacccagcctgttctggatggaagttttagctttccttcttcttgattcatagaatacctggtgaaaggtatttccctccaatattcatctaaagttttgatttttctggcctggttcagcagttcctcctcattccactccaattgataatccgtgtatgcttttgtcagaagtgatattctgcggataagaaactgcatgaaggtttcaaaagggagcttatcaaacagcttatctcctgatacaattctaagcggtgtatcaaaaaacaggcttgcataagatgcatttctgcctgctgtctgcagtggtctgggagatagattacgaatccagctctttcccccggcatagatcaccttacccgaccctgaatcaatcacctgcatcaaccgaaaggaaagtcttgctgctccccatcctttctgctctgctgccaacagggcatctaaatatacgcctgctctttctcctcctcttccgagtaatgtaagatcaaaaacgcataagtcacctttcttccatctctcccttccttctccgtgtacatacaacacatatgggtttactgcgcctgcctccccaccggtattactgaaacattgaacatagagacatcctttctttttctcacattgaaagcatcttttagcaggatattcacagcagaaatcccggatacaatgccctaaaattcctcttatagtagaacccaaataagaaggaagcctgccttcttcctgacattcatatgttgcacgcaatgttaagatatttatgaactcgaacatatttcctccccggcccgattacggtttattttattacattatatcctatattttccaaaagaaaaacctttttaatttctatttaaattctgttatgacttttatccgttactgtacatagcacattaaaatgtagattttatacaacaagacacttcgtgatacacctgtcttctgtttgtaaaacagagacagcatcagtccacctccgacatagcctgcgctcttaagattcttttgttctaaaataaaagctcctccataaatctccttctaaaagcaactaagatactaaagatctttgtcacaacataaaataaaatgaaacatcctatattcaaagcatgttataatgtgaatacaagaatcggtacctataaaatggaaaggaaatatagtgtgaaagaaagtagaggatagccaaaaagtgacgtactttaataagctaccagaaatggtaacctgtaaaaaagtatagatcagataattagtttaggaagccaggggttccaatggaggtaataacccttcgcgtatcagtaacttctgcgcttgtttgatagccttttgtttttgcttttcaagcaaaacctcaggcatatcaattttgtataaatcactaggattccatgcttcaccagtagacagcatctggaagatagcagtgagaatcatacgagcaatagcaataatggctcttttttttaccccgacgttttacaagagattcatatttctttttgtagtaaggagattggtcggatttcacggccgtatgagcgcattgtactaatgcaggtttgaggtagacaccagcacgagtaatgcgaacagatttcttcttacccccagattcgttgctccccggagttaatccggcccagcagcataaacgctttgaggtacagaactgagtcatatcaataccgatttcggagatgatagtgattgcactgtcatgttttacacccggaatggtacagagtaactgaacagtattttcataatcaggatcagaagaaatcagattttctatcatagagtctatatcagtgatttcggctgtgatataatccatatgtgcgcggacgaggcgcatacggtatttttgggcatcagtcatctgatatccctcgatggattctataacggcatctgttttagatttgagacgtctaagaagttttgatgcgatttcttcgtggttaatagagtgaccggactgttcaagcaggtagtcaataatggatgtggatgatttcccgaagatatcggaaactactgaatctaatgcgacattacagacagtgagcgcattctgatatctgttcttttcactggtacggcaggaaacaagtttgtagcgataccgagtatattcacgtaaaatacggatggtcttacaaggaacataactgcctctcacaagtccaagacggaacaagtccccaatccatttggaatctttcgtatcatctttattgcctttgacagcttttacccatttagggttagcgatggtgacgtttatttcgtcttctaaaaggttaaagacagggatccaatatttaccggtggattccatacagacatcccggcagttattgtcgagaagccagtgcttgaattcaagaatagaattgttaaaggtggagaaacgcttcttttgatacgaaggttccacaccggaagtggttttaatgattgtggcaacgagaaaagatttgtgaacatcgacaccacaacaggtttgataaacaactttcataagtcagactcctttcgtaaaagaagagaggccattgactgaactgccacacaattaaactaaggcgcttaaacaattcttagtgtgcggactcatagtaccacttatttgtgcttgaaaaggcagaacttacactgattattatgctgtctaaaacgaagaaagttattacaacttctcctcccgtgctttgtagtgtagcttctcacaagctattttacaccaaagagtagaagttggaatactttcattactatttgtgccgccgcttggcggcggaatggagattagtgtgaaagaaagtagaggatagccaaaaagtgacgtactttaataagctaccagaaatggtaacctgtaaaaaagtatagatcagataattagtttaggaagccaggggttccaatggaggtaataacccttcgcgtatcagtaacttctgcgcttgtttgatagccttttgtttttgcttttcaagcaaaacctcaggcatatcaattttgtataaatcactaggattccatgcttcaccagtagacagcatctggaagatagcagtgagaatcatacgagcaatagcaataatggctcttttttttaccccgacgttttacaagagattcatatttctttttgtagtaaggagattggtcggatttcacggccgcatgagcgcattgtactaatgcaggtttgaggtagacaccagcacgagtaatgcgaacagatttcttcttacccccagattcgttgctccccggagttaatccggcccagcagcataaacgctttgaggtacagaactgagtcatatcaataccgatttcggagatgatagtgattgcactgtcatgttttacacccggaatggtacagagtaactgaacagtattttcataatcaggatcagaagaaatcagattttctatcatagagtctatatcagtgatttcggctgtgatataatccatatgtgcgcggacgaggcgcatacggtatttttgggcatcagtcatctgatatccctcgatggattctataacggcatctgttttagatttgagacgtctaagaagttttgatgcgatttcttcgtggttaatagagtgaccggactgttcaagcaggtagtcaataatggatgtggatgatttcccgaagatatcggaaactactgaatctaatgcgacattacagacagtgagcgcattctgatatctgttcttttcactggtacggcaggaaacaagtttgtagcgataccgagtatattcacgtaaaatacggatggtcttacaaggaacataactgcctctcacaagtccaagacggaacaagtcaccaatccatttggaatctttcgtatcatctttattgcctttgacagcttttacccatttagggttagcaatagtgacattgatttcatcttcaagaagattaaagacagggatccaatatttaccggtggattccatacagacatcccggcagttattgtcgagaagccagtgcttgaattcaagaatagaattgttaaaggtggagaaacgcttcttttgatacgaaggttccacaccggaagtggttttaatgattgtggcaacgagaaaagatttgtgaacatcgacaccacaacaggtttgataaacaactttcataagtcagactcctttcgtaaaagaagagaggccattgactgaactgccacacaattaaactaaggcgcttaaacaattcttagtgtgcggactcatagtaccacttatttgtgcttgaaaaggcagaacttacactgattattatgctgtctaaaacgaagaaagttattacaacttctcctcccgtgctttgtagtgtagcttctcacaagctattttacaccaaagagtagaagttggaatactttcattactatttgtgccgccgcttggcggcggaatggagattaaaatgaaaattactgttatacatggtcaaaaccataaaggttcaacatatcatattgctaaaatgctttatgaaaaattggacggtgaagtcactgaattttttctgcccagggatttccactctttttgtatcggatgcacaaactgttttgaaaagtcagaaatcttatgtcctcattatgaagatttaaaatatattactgaatctctagatagtgcggatgtgatcatactggcaagccctgtatacgtatatcacgtaacaggagcaatgaaagtttttttagatcattatggatatagatggatggtacaccgaccagaagaaaaaatgttccaaaaacaggcagtatgtatatctaccgctgctggtgggggcatgaaaagtacaaccaaagatatggctgatagcaccttcttttggggcattgccaaaacttataaatatggtgtaggtgttgcagcagtatcatggaataccgtggattccaaactaaaaagtcgcattgacaaaaaaaccactgtcttggctaaaaaaatcaaaatgaatctggggcatgtatcacctggcatcaaaaccaaagcattttttcacctcatgcgttttatacagaaaaaaggatggaacgatgcagatgtaaattactggaataagaaagggtggaatgggaaaaaccgtccatggaagttatgaatatttcaactttcggcaaaccctcttccccaggtcaacagtttattttttcagtcaaatccagaccaatatcttcttttctattaagtatatataaatccgaatccgtttgacacatccatctctgccctttacaataaaagtagttataaattttatcataatggaggtgtatttttatgctgcatgaagtaagctttccatcttacaacaaacgtgaccaggtgcaggggtggatttatgccccggctgccaaaccaaaaggaattgtacagatcattcatggattcggggaacattcaaggcgatatctgcacatgatcgtaaaattcatggatgccggttacattgtagctgccgacgaccatgtaggacacggaaaaacggcaacggtcagcggtgtatggggtgattggggtgatgcaggtttccgcactatgatggaggacgaacatacactaaaaaaagtagtctgtgagaaatatccaaatcttccatatttcattttcggtcacagtatgggatcttttattgccagagattatgccgcaaaatatggagatgatctggcaggtgttaccatctgtggtacaacaggaatcttcaggggcgcagataatgctgctgagcttctcaaaaaatccttggatgacgggcggggaatggactctgatccggaattcacaggcatcttaatgggatggatgtgcgagcgatgcgatgatgtcacaatcggaaatgaatggatctgtgctgacccttatgtacagcgcgaccacgcagaagatccttttgacgcttttacgaaacccaccagtaaccgctcactctttgatttcacccaaatgatgatggcggtagaaggtatacagtgggctgaaaaagtaccaaaatctcttccattttacaatatcggaggtgatcaggatcccgtaggagaatatggaaaaggaatctatgaagtctcaaactggctgtgtgataccggccataatgtgataaccaaggtctattcgggatatcgccatgaaatacataattacagcgatattaaggatgacgttgaggccggaatcattgcatttatgaacggaatacttgatatttaaacgaaaatatcttacagagtgggagtgtgaaactttttctgtaaatatgtgattgaagggttcttctatgataaaatcaaaataatcataggagggccttttattatggcaagagaaaagaaaccagtacacaaagtacaaatgacagaagggaaacgcaacatcatccatcagctcctggaggaataccatatccaaacagcacaagatattcaagatgccctgaaagatctcctgggtggaacaatcaaagaaatgttggaagcagaaatggaggatcatctgggatatgaaaaatctgaacgctctgataacgaggattaccgaaatggctacaaacgcaaacgcgtaaacagcagttatggtaccatggagattgaggtccctcaggatcgcaaatccacttttcagcctcaggtcgtaaaaaaacgccagaaagatatttcagatattgatcagaagatcatttctatgtacgccaaagggatgaccacccgacagatttctgaaacgatcgaagatatttacggctttgaaacttcggaaggatttatttctgatgtaacagataagatccttcctcagatcgaagactggcagaaccgtcccttagatgaagtatatccgatcctttttatcgatgcgatccactattctgtccgggataacggagtgatccgcaaactagcggcatatgtgatcctggggatcaatacggaaggaaaaaaggaagtccttaccattcaggttggagataatgaaagctctaaatattggctttctgttctgaatgaattaaaaaaccggggtgtaaaagacatcctgatcctttgtgccgacgggctgtccgggatcaaagaagccatcgcggctgcattccccaaaacagaatatcagagatgcattgtccaccaggtgagaaataccttaaaatatgttccagataaagacaggaaggcgtttgcagcagatttaaagacgatctaccaggcatcagatgaaaagaaggcccttgcagcccttgaaagggtaacagagaaatggacaccaaaatatccgaattccatgaaacgctggaaggataactgggattctatttctccgatcttcaagttttcagcagatgtccggaaggtcatatacacgaccaatgccatagaatccctgaattccacgtatcggaaattaaaccagcagagaagtgtatttccgagcgatacagcgctgctgaaagccctgtatctagccacttttgaagcaacaaaaaggtggactaccaccatccggaactggggccaggtctacggtgaactgagtattatgtatgagggacggcttccagaataaaaaacagtttggttaaaacaggcggaaaagccgcctgttattgacatgccatcctctggatggtataaataaaacaaaggtggaatacctaatttctaagcattccaccaaatcttatcatagaagaatcctatttacagacttttcttcataccctctacagagtcttctatgataatataaaattcataggagactctgtattttgcaaaacaaaagaaaccaatacagaaagtacaaatgacaaaaggaatacccacgactccccatcaactcttttaacaaaaaaaaggcccaaaaaccttacaatcactagaaaatatagtgtttataaagctttcggaacctttcaaatacttgcattaaagtttattgcaaacttcgcttagttgcccatctgtttagcaacttcctcagcaaaattttcttccttcttttcaataccttcgccagtctcaaaacgaacgaagccttttaccgcgatttttgcattgtttgcttttgcaacttcttctacatatttagcaacagtctgttttccgtcttctgcttttacataaacctgatctaacagacagatttctttcagctctttgttgatacgtcccataaccataccgctgatgattttgtcattggcatctggtttttcgttcttagctgctgctgtcaggatttctttttcatgctcgatatattcctgggacacttcatttctgtttgtgtacagaggtttcagagctgctgcctgcatagcgatgtttttagccatctcttttacagcgtcgttgacaacatctgtctcaacgtcaaccagaactccgattttaccgcccatgtgtgtgtaggatgcaacaaaaccgttttcttcgcttacttttgtgaatcttctgatgttcatgttctcgccgataacagcaatctgacctgccagagcttcctgaacagtctttgttgtatcgaatttccaagcctcggctaagaaagcttcaatatcagcagcttctgtgtccatagcctgctctgcaacctgtgcaacatagccctggaatttttcgtttttagcaacgaaatctgtctctgcattaacctctacaacaactgctttcttctcatcagcagatacaagagttttgcacagaccttctgctgcaacacggcttgctttcttctgtgcagtagcaagtcccttttctctcaggaattcaactgctttatccatatcgccttctgttgccgcaagagctttcttgcagtccatcattccggcaccggttttttctcttaattcttttaccattcctgctgtaatagccatcgtgatattcctcctgaattttattggttttttctaaagaaccgccttggcagtacagccaaggcgctttggattattcctctgttgcttcctcttcaactgcttcctcgaagatctcgctgtcttctgcagcaccctggttagcctcaataacagcatctgccattttggaaacgattaattttacggctctgatggcatcatcattgcccgggataacgtaatccagttcttccggatcacagtttgtatcacagataccgatcaacggaattcctaatgtatgtgcttcctgaacgcagattctttcttttttcgggtctacaatgaagatggcatccgggagtttcttcatttctttgataccgcccaggttcttctctaatttggtctgctcttttttcagctcgataacttcttttttcggcagtacatcgaaagttccgtcagcttccatagcttcgatctctttcagtcttccgattctgctctggattgtcttgaagtttgtgagcattccacctaaccatctctggtttacatagaacattccgcagcgctctgcttctgtctttatagaatcctgagcctgtttctttgttcctacgaacaggattgtgccgccgtcagctgcgatgtctgcaactgctttgtaagcgtcatcaaccatgcctacggatttctgaaggtcgatgatgtggattccgttacgctctgtgtatatatacggagccattttaggattccatcttcttgtctgatgtccgaagtgaacacctgcttctaataactgtttcattgaaataacgctcatgttttttctcctttttggttgttttcttccgtctatttcctctccgcagggacactgtcggacgcttgtccgcaggcaccgtcctttggtattcatagacgtgggtattttgcaacgttggtattatagcatagctttcccatatgttgcaagctgtttttaagattttttcctatttttacaaggtttatactgcttttactcactttctgccacaggcattccaaagccaggtgcgcagaagcggcatccaactctggcactcctcctgtactccggtgccatctgtacgcatcagagcttcatttgccagggaaagaccatggctgccttttgggtagagatggaattctgccggaacgcctgcttttcccatagcttccacaaataaaagagaattttggaaaggcacactctgatcttcaaaggtatgccagatgaaagcagggggcacatggatatccacctggttctccagcgccatcattgctttcttttcctcgtattcactgcccagcagattatggatactttccaggtgtccgtaatcttcccgtgatgtaatgacaggataacagaggatcaatccttttacttttaatatctctttactgcaccccacagcttcccgcagaaaatccctgttccaaaagacaccaaagctggctgccagatgtcctcccgcagaaaatcccatgacaaagatattatcggtatctacacgccacgcttttgcctgttcatggatcatctgcacagaacgtgccacttcggtcagggctgtgggaaatacacagggagcacaggaataacgcaaaactgccgcgtggtatcccatgctgttaaactgcagggcgatcatctctgcttccctgtcagcggtaaaacggtacgcaccgccgggacagattaatatgaaagggcgtaccagatcttccggctgctcctcataagcatccaaaatataagttgtcaaatgtgtctcttttgaagacccggacatttgaatgggaatcttctcatgtatcatactcttattctcctcttattccttctcgattatctggccgtttctgtaggccttcagcagttgtttcagttcgtcaatgctctcctgaaggtgatgtccgttgtctgtatctcccactgtttttcgcagagaggtacgttttaccaaaatgctgtcagagagaatatcgctctcccttgtgatggcatcctctgctgaagtaaacggctcatgagccgccaggatcattccccaggaattatagatcagtgtgtatccagctattcctgtctctttctgatatgcctttgaaaatcccccgtcaatgaccagcaccttgccgccgcatttaataggactttcccctgacgtgtgatgcacaggtacatggccgtttataatatggcagcagtccccctcgatcccgaactcccgaaaaatattatccactacgttctcatcttccaaaagcctgtagtaagaatttttcttctccacatgcgtttccttttctgccaggaaataccgttcaaacgtagccattttatccttaccgaacagcggggaggccgggctgctccagataaaccacagaatatccctgccccgctgcttttcttctttgtccagggcaaaaaatgcttttctcacataggattccagcacatcatagagttctcttcccttataggtcctgccatatatttcaacttctttaaaactgccgtcatcgttgagaggtacgcagccgtgatagagcaggttgttattatataccttgtacagacttccttttttcagcaggagctgcatatggcgctggagcttctcacaattggcaaaagcagagacaagacgttccatgacctcctcttcctctttggacagttcatagggattttccgggtccacagtgggaaacgcatggtctagaagattatattcttttccatacaggcgtatggttccatcctcataattgatatcatccagcaaagccctgtctgccatatggaactcttttctcctgataagaagctggccttctaatttaaattgaataatagaaatggctttgtgcatcttcatattcagcacagtttctgccggattgagtgtattaccgcctttgatcttaaagcactcacaggggtcctcctgataatatgtcagggcaaaggtagccaatggcagcagattgatgccatacccgtcttccagaagatccagattcgcgtagcgggcacagatacggatcacgttggcaatgcaggagcgctgtcctgccgctgctcccatccagacaatgtcatggttgccccactgaatatccagggaatgatactcctccagcttatccataatatggtgcggccccgggcctctgtcataaatatccccgagaatatgcagatggtccacaaccaaacgctggatcagctctgaaagggctatgataaacacctctgcccttccgattgctatgatggtttcaatgatctgctcataataagcttccttgtcattaagttctggtttctcagtgataagctcctcaatgacataggcaaaatcaggcggcagagctttgcgtactttggaacgggtatatttggatgccacacgtttacatacctcaatgagacgatataatgtgatcttataccaatcctccatattttcctcagtctttttgatcagctccatcttctcttttggataataaatcagtgttgccagggaacgcttgtcttgctcattgagtgtatgaccaaatacctcattgatcttccgtctcacagaaccggaaccatttttcagcacatgggaaaacgcttcatattccccgtggatatctgtcagaaaatgttcggttcccttgggcagattgagaattgactgcagattgatgatctccgtagacgccttggcaatggtgggatataattcagaaaggcgctcgagatatttgtgttccaatttttccatttgatttcccccaatatttatagattaatccatgctgccattgtaacacattttcttctcccagaaaacaagaacacttccaatcagtaaaaaaataattcccgccggattttctttctgcattttcactgcctcaggtccgggcattgtatctgcttcagcgtcttctttcaacggcatgataaaatcccatggctccatgtcatttatattgcccgctgtatctctgacagaaagagtaattctgtttttgccgcttttcaaacattcggtgggaatcctcaattttccttcctcccactcatagagcacaggttctccgttcaccgcgcaggaaatgatctgtatggcatctgtattgtccagggtaatctccggggaaaatcctgtgctgtatgtactctcctccctgtcgaataaaaaacttgtacccgactgattgacggaaaaaagaaaacgctgctctgtctggttgccgtatatgtcagaagcccggcatataagtatatattcgtcatcttctgtcaccggatccagggtaagtgacagaccatccctgttctcttccttttggaatgaaatattcctctcacctgtgcgtttccccgtaagccggatcttcacactgcttttgtcaagattttcatcctgcactataatacatggcgccactcggctgttgtttgatgagagatttttcagatttgtaagggtgacaacagggcatctgcaatcgggaatctctatctccgtcatggaatgcagggacgactggccgttagtcttttgtttcttctcggatccatttttcccattctctatattaaacacatcttttcccttacctacttctgtatctgatctacctccttccgtatctggcttacctcctagtataataatggtgtagtcaagaatgactactggttaatagttacaaagtccaatctaataaatctatatagatataacggaaggaggagttccccctccatcagaagttataaagtaacattatttaccatgtctgaggtttccttaatgcaccagacaaaagatagaggtataatcactggaggcaggatcattgacgacacctccttgggaaccggccttccggctggtgaaacctcttagaaagtctgtcagtccattcggtggtgatttatgttttggctggttgggaagccccaggctaatacctgtataaaccgctaggttgtgtatccaccttttggaaatggatgcctgccagaaaggataaaaccatgaaatacccaaaagtacttatgatgcttgaaagcatcccttatctctcagtcgggcttgatgtcggtgcagacttcacctggatgtccatcatgctgcccaatggcattctcaccgggaaaccttttaagatcattcattctgatccgcagtcccgtgagcttgctgtcgcaaaaataaaggaagcacaagagatgtattccctcgaaagccgctgcttccttgagtccaccgggatctaccacatcccgctcctgtacttccttcgtgataaggggtttgactgctcagtcattaatcctatcatcactaagaatagcacaaatatgaacgtaaggaaactgcataatgataaatttgattcaaaaaaagctgccaaagtcggcctggatgcttcccttaagacttccatcataccagatgatgaggtcattgacctgcgcaacctggtacgggactactattacttcaaagacatgcagtccgctgtcgtcctgaagctcacggcggaactgaaagtgtcctttcctgcataccggaaggtgtttagcaaggtcactacccaaacttccttaaagcttctggaagcttacccccttgccgcagacatgcttgccgccccaaaagacatacttgtggaaaccatacgcaaaaccgcacgtttcggtgaaaaatatgccgtttccaaatatgatgccatacgtgctgccgcaaaggacgccgctgttttcggacgtgcgcttcaaagcagtgcactccggatccgactgtatatcaaaacctaccgggaataccaggagcatctggacaatatacttgaggacctgcataaggctgttgataagctggaagggacgccggtttatgaccgtatcttccttctccagtccctacgtggtgtcggttttctcagtgcagccgtcctgatcgctgaaatgggctcctttgacctgttttcttccccaaagaagctttatgcttacttcggcttggatcctgccgtgaagcaatccggcaagttcaatggggataaagtccacatgtccaagaggggttctagccttgccaggcgtatcctgcatatggtggctatcaataatcttaaggtggataaagggacaaaaacaccagtaaatccagttatccacggctattataccgacaaatgcaaaagcaagaagaaaaacgtggctgtcggggctgtcatgcataaaatctgcaatatcatttttgccatgctccgggataataaaccatttgagatcatcactcctcaggaacactgtgagcggtatctggcagcgcatcccgacaagatacagaacgcagcctaacaggtttatcatgaattttaaagatttccacatgggtgggcttattaaagttacccttttttacatcaactgcttgaaaaaaacttttttaacatttttcattttacctattgacatttcttagctggactttcgtatccgacataccttcttccgtatctggattactttcttccgtgtcagacttatcttcttccgtatccggcttacctccttccgtgtcagacttacctcctttcgtgtcagacttacctccttctgtatcagacttgttactttccgtatccgacttgcctccttctattccctgtacgcctttttctgcatctttttcttcttctcccaccttatccaaagcatcgttttctttcccatttttatccgaatgtgtactatccgtctcttcttttgggactgtactttttacccgaattctataacggaccaccacctctgtctccccttcctccagcgcttctatatttccattgcttcctgtacaggcaatgcgttcatcttttatctgcacaaagccgttgtcaggcaggaaaagttcctctcctttccgcagttccacgatctgtgttatctccggcaattccttatccatatctctatgtgcatctctatccgtttccgaagccaatacagaaaccgcagtacatgaatataataaaatgactgccgctgccataaacattaaatttcgcttcattctgtttcctcctttgtcacttcattgattctgctctttattttttcactgttaaagcccgatttttctgctcctttttgatccataagagaaagcagatactctgccttttgccagtttccacgttccattgcctccatgagggcataggcgcaataagcttctgcgtccctgggataatcccgtagatagttctcataccatttttccgcttcgctgtaatttttcatctgtcggtacatggccgctgccgagaggcggacttcctgttccaggtccacaggtattttttcattcaggataagcttataatagtttatgctctgtaccgaatcatccagtttctcacagatctttgccaattgataccagatttccatgaggtatacaggcgcatatgtctttcttatattctcttttacatttatttcagcctgacgaagaagatcccgggctttttttgtgccctctttttttgcgtatccaagctccgtatcgtatgcctgtacaacatttgccagaaatatctcttccccggccttttcccaggaagtaccctcgctgttttccaatgccttcatggccttctttgcctcttcccagtttgcttttactggcatctcctctatggtgtccaggatgatacggtacatctctcctttttctgtcccctcctgttctctcaggaaatatctgcgcgcttccccgtaatccgccgtatccaaaagaccggtcccttcccggatacccagcagtctccccgcgtcaagcagcagctcctgcctcctgacctgggcacctaacagcagcaaaagccccacggccagaaaaatggagcctgcccggacacgttttctgttctgtgtccagtcttccagattctgcagttcccttttcactgcgctgatgttcctataccttttccccatggaagtttccatacatttttccgcaatctgtctccactttttatgcagcttcgacttgccctcatccttctgctccatgtaaagcaggatagccccaagcccataaatgtcagtccgctcttctgcattccccagaaactgttccggcgctgcaaaaccaggtgttccgtaaccgaccatgcccctgcggttctctgcactgtggctgctctctgcactgtggctgttttctgcaccgctgccccgttctgataaaaaagcaatcccgaaatcaagaagcctcatatcacctgaaatgtgcaccagcagattggatggcttcatatcctggtaaatgattccctttgccggaccatgaagatattccagcagactgcaaatctgtatagcccactttatcctttttttccaaggtattctttttccgcttttctttatctcctccagggtgaacccttccagatagtccatgaccagatagcggtatccgttctcctccagtacatccgtgatcctgggaagtgccgggtgctccagatgccgcatgatctccgcttccctgctgctgccgtcaggaatttttttcacagcccaatattttctaagcttcatgtcaaaggccaggtatacctttccctgtccgccttttcccaggactttttccagacggtaacggcctccgagaagacacttttcctcatacatgaacagcatcacctcttaaatggttatcatatttacaatattttcaaaaatggaatgttcggcagatatgccaagaatttcccgtaactgtaaagaaactgcacagttacagagatcaaatatatattgggaggttccgccgtatgcagcggaaccgtccacataatgtcagtttacattctctcaggtgcttcaaatcccagcagatcaatgcatgtctccagtacatctcttgccagaaccagcaggcggatccatgaagttttctgtgcctcattctcctcactgagaatctttgtttcatgataaaagctgttgaaagcatttgccaggtcatagatataggagcatatcttatggggcgctttctcctcaaaagcaggcgcgatcacggaattgaatctggaaagctccagcatcaatgccttctcgctggcatttgccggctgaagcattgtaccttcttctgggttcctgccctcctcccggtagcgctccaggatggatttgatacgcacgatggtatacaggatatatggtcccgtattgccctcaaaggatgtaaaacgttctacgtcaaacacataatccttggaagcctgattcgacaaatctccatatttgattgcggaaagccctaccatctcggctgtctttttcgcgtcatcaccttttacactgcggttctcaacgattttcttatacatttcctcattgatttcacttatgaggcgttccagacgcatgactccgccttctcttgtcttgaaaggcttgccgtccttgccgttcatggttccgaatcccacaaacgcaagttctgtcctctcatctgtcagttttgccttcttcgcgcagcggaatacctggataaaatgcagttcctgacgcttgtccaccacatagatcatctcatccggatgataatcctccatacgctggacaatggtagccagatccgtagtgttataaagagatgcgccgtctgatttgaggatcatacagggcggtatctcctttgcatctgactcctcttttacatctaccacaagtgctccctgatccagatatgcatatccattgtctttcagatatgccaccatatccggtatatacgggtctgcatccgcttcccctttccaaaggtcaaagtccacatgcagtttctcataattctttttcaggtcagcaacagacacttccataatatgtttccagagagcgcggtatccccttctgccctgctgaagttctaatgtagcctccagagcctcatttttataattctcatcttcttttgatctaccgctggctgtgggatagatttcctccagctcgctgacagtaaacggtgcctctgccggatattccccttcataagactcatcaaaatacacaagctccggagaacgtttttttaactctgtgatgatcagacccatctgcaggccccagtcacccagatgcacatcaccaattactctgtgtcccaggaaacggcccatccgttttaagctctcaccaatgatcgctgaacggagatgtcccacatgcagcggttttgccacattcggtccgccataatcaataataatagtcttaggagactctgctttttcaacggaaaggttctcgtccgcctgcatatcgttcagataagatgccagaaacacagggttcagcttcagattgataaatcccggattcacggcctctgcctggctgaacatttcactctcttttattttctcaaccacatcgtttgcaatcatgataggtgctttcttatatgtcttggctgctgccatggctccgttgcactgatactcgcatagatccggacggttggatacattcacacgggcaaatttttcgtcatatccggaagctgtgaatgcgtctttgatgactgcttccatgcattcgatgattttcttcataactgttcactactccacttctacttttttagaaactgccacggccagagcaccctgtccaatgtgacaggcaacactcagggacagagggtccatatgcacttccatgccgaaatgcttttcaagctccgctttccattcgagagcttcctcttcattgccggtataggccgcctccagacacatgaggccttttttcttatggtccttaaaccggctcttcagatcttcctccatggctttgaccatcacacgctttgcctgctttttacccctggcttttgaaaaagcatccagcttctccccctggatctgcaggaccggctttaaattcagcacagtgcccagtgcagcagccgcaggtgtgatcctgccgcctttttttaaatacttcagtgtctccagagtgatatagatactggactctcctttttcggcttccagaatttccttgatctcaactgcatttttcccagcctctgcaagcgcaagcgcgtccagcacggattgtctctgggtaacagaaatcctttggttatccaccacctgtacacgtcccttatattctctggccagcacaaatgctgtctggcaggaattgctgagaccgctggacatggggatgtgtacaatctcatcatggtccgtgagcagccgctcccaggtctccagaacatcagcgggagacggctgggatgtggaaatatccgcgtcctgagccagccgctcataaaaatcctcctggctgagagtgatcccctccaggaaaagctgttcattaatataaaaaggcatcggaagaactgtaattcccagctccccggcgtactgctgggtaatgccgctgttactgtccgtcacaactgcaatcttctttttttccattgcttctttgactccttttccccattttgggttactatttttaataatatcatagaccggagttaaatacaatgtctcctccgggaaaattttgacgaaaaaatcactgcatgttataatagatttcagataaaatactgataaggaggatcatcatgtcatttcaaacagaatcatatgccaacacagcaaaaactatcataacaaatctggaaaaaaggaatatgaaagggtattactgtaaaaatgcccgggaagccagagaactcatctgtcagcttattccccacagctctaccgtaacctggggcggttcagaaacactggtggagacaggtgtgatggatgttttgaaacaggaagactacatactgcttgaccgaaagaacgccaaaacacctgaagaggccagggcgctctatggaaagatcgtgaccgcggattattttctcaccggcaccaatgccatcactctggacggcgaactgatcaatgtggacggtatgggaaaccgcgtagcctgtctgatcacaggtccccagcatgtgatcgtagttgcgggaatgaataaagtgtccgtctcagaagaggacgggatccgacgagtccgcaatatagcagcaccgcccaacagtatccgtgtaggggcaaacacaccgtgttctaagacaggtgtctgtggggactgccaaagccctgactgtatctgctgtcaaacggttatcacaagacgttcccgtgtaaaggaccggatcacagtcattctcattggcgaatcttacggtttctgattgatgaatttcacattttctaattagtaaatcttactttttttaatttagtaaatattgcattttttgattagtaaattccacattttctgacaaagaaatccggctgctcatacagataagctgccggatttcttatattttcttacattcttctcagtgcttctatcggacttagatttgccgcttttatagatggcagtaaaccaaataccagaccgatgatcatggaaaacaccactgctgctgctgctgccgggatgctgatgaccataggtgtctgggatattctggatatcacttttgacaggataaaacctgctgccacacctaaaacgccgcctacgctggtaagcactgctgcttcggtcaagaactgacccaagattctgcgcttattggcaccgatggcttttttcaggccgatttcaccggtacgttccgttacagacaccaacataatattcataacaccaataccgcccactaaaagggaaatactggcgatccagataagctgccggttggtattctcactgatctgctgaagcccctttgccttctccataatatcctctgccttatatttgatagagtctgatgaagatgttatggatgtattcaggatttctgcggtcttcttgcctgctttgctcatggcctccggactggctgcccggatgactgcctgctgtggttcatcgtattgatacacaatgggccacgctgtatccggcatcaggatcatcccgctgtcattgctgtagtacgtataatagtcttctatactgttaatgaccggctcatattcatctgatttttttatgatccccacaacggtaaaaggttccccttttatctctatggttttgccgatttcccttcctttttcaaaaaaattgttggaagcggtctcatccagcagaatcactttgcggaaattggaaaaatccttttgggaaaatccccgcccacggacgatctgatatccgcaggtgtctaaataatccttgtccactccaagtaccttgccgccgtccatactttgattttgataataaatactgtccgcatactggcgcagtctgtagagtgacgcattttctacatgatccagagccaggatctgctgtttctgctcttctgtgataaccggcactccctggggtatcccctgatattccatctgataaatgttgctgccctcattcagggtgatatccacaacattatcaccttcaccaatcaggttctttttaatctgctcactggttcccttgatcgtggacacaatggaaatcagagatgcaatcccaatgattatgcccagcatagtgagaaaagagcgcatcttgtgagcccagagtccctggaaggacaatctaatattttctaccatgttctatcctctctcctccggtagttcataaaatcttcctctttcataatgaactactagtacatgctgtaaaggtcttctatagctgcacgtctaaccttgacaccttcttttaccttcttgccatatggaaaagcgatatggtcctcctccgtaaggccatttttaatctccagcatactgccgtagaaattttttcccacctgaacgtttcgtctttccagcctatggtccttgccctccacatagacaaagtctttgccgtctttattcctcacatattccttgctgatataaagacctgcgggattctctgtctctgagggaagatccaggctgacgccctccatatttttaagtccgtcactgtttttaatatacgcagtgaagggataataggacacctcacggccgtagccatacatgttattggatgacggaaaattagatatttctttcacttcggcctcgatgggaagccctgattcatatgagaatccggtcagaactgagcctggctggagctgctgaagctgatactcatctgccagacctttcacataactgccttcagaactctccacaaccagaaatgcctccccgtccacttcaccttttccgggatctcccacttttttaacaacaccattcagaatagattctactgtctgattttccagctttttctctacattctgtattttcaggctgctgccccgaatatccagttctgcagtctttatctctttcttcttttcagtgattgctttgttcagttcatcttgtgtgtagccttctatgatatcatcctgagggatctcctccatgaaatcccagtcatcagggaactcttccccgtcatcaccatccggattttcctcgtccggaatttgaggctcttcctctgtataagtaccaaggtgagtcagataccatttctccggtgctgccaactgggttatcttacttccgtcaagacaaagcgctgctatgagaaatccatccttgtcatccttatctctgacttccaggatacaatataccggctctttttctttggtatcagaagttccgtaacctgctatctgattcaaaaaggctccctgtatctttacgtcttttttacaaagatagtaatacgggtcttcctttgtacctgttcctttatagggaatggcattttctattttctggccgggtattgtttcaagagtaatgtctccgtaaagtttatcgtataccattgacggcacaggcttattgggtttttcgggattgtccgagtcgcccggattatctgtgtcatctggattttccgagccgcctggtttatcagaatcatccggattttctgagccacctggtttatcagaatcatctggattttctgagccgcctggcttatcagaatcatctggattttctgagccgcctggcttattagaatcatctggatttcccgagtcatccgaatcgcctggatttcctgaatccccagtatttcccgagttctctgtatcatccgattttcccggatttccctgttcaccggaatccgctgttcttcccgcattttgagaagccgccattttgctaaacgacgcttcccatcgtccgcctgttcctgtatttgtctcttttaaaccaagaggaagtattcccgctttgctgccggctccaactatattaccgccggagccctcaccgcctgcctctgacttctggctgtcagggattatgttggcatttttcagtttctccaattctttttccagcccctttttcttgaccagaagctgttctttgtttatcttttccatttccagatcaatgttgaccaaagtcatatcatatgagagaagaggggttccttcaaccacttcctgcccttcctgaacatagacctgatccacgatctgtttgtccatcagatggacctcctgtgtcacactggaggatatggtcccgtcaatgctggtactcattccccatatctgctgctttagatcagccacgggatagacgtccactttggtctgatccatcttttttacgccataccagattcctgtacctgccagcgctgccacgcctgcacagatgacggcaataattatttttttatttctcgccttcatttgaatcctcccctctactgcgcctcaccttccggaccgggtgctgtctccccgtccgtacctgctacaccggcctcaccttccggagcaccggcttctccttccggggcacttccttcaaagtcagcacctcccgcttccccttctgcgggaagtacatctgccccgtctcctgcctgtggaagggcttcagaaccctcaggcatttctccctctgcaggcattgttgtctgatcgttcattggaatttcttcgtgtgttgtcttcattccttcttttaagaattcctgaggaaacgcaatatagtcatttaccttcaggccgcttttgatctgatactggaacagattctcgtcgtgttcaccaagagttacctggcgtttttcaagctttccgtctttattttccacccagatacaaggctgctcgtccaaatccatgataaatccttcatccagccatatgccttctcttttctccattcccgtatcattttctatatatacgtgctgacctaacataagaccgtcagaggagtccaggtttatataaaagggataggaggaggacatcatctcaccgctgtcactgctgcctccgtacatcatgttattgttgtttccctctctgttttccgtatcaacagctgtaaaggttccgctccacgtcttgctctcatcaactctggaacggatgactgcctttgtaccttcctgaacagctcctatattctgttcgtttactttccctttcaccctgtatacaccggttgccaggattgtcataaatgcctgtgaattgccgctgtaagcatctgtctcattgccttcattaatgcttttcacaacaccctgcagttcactggtgacagtggaattagctattttttcatgtatctgtgatatttcaacctctttgcccttacgctcgtattcactttttttcaaatccatctgcgctgtctggatttgggttgtataggaaaactggtcatcctcagaagcggatttcttttctttttccaattgtgcgatctgactgcgcaggttttccatgtccgtatccgcccgttccagatccaactgtgcctgctgcagatctgcttccagactctctgtatcatagataaaaagggctgttcccacctcaacctcgctgcccacttccacaaggatctcttttacttctctttccgcattcttttggatctcccatgtcttctgcggttccaccacgccagccatccgctgaacctgagaagacgggtccatagaagagacactggtcacataagccagttctgtacttttgtcctctccctttccccgctgcatgtaaatccccgtaccgatcacacctgccagcagaacaacgcctgctccgatgagaattttattttttttattcatacatttccccctgattcttttatttgtaagtgttcagtctccttacattaatgagaaaaatccatacagaatcgccttcgacaatgaaattattgcctgaaaacaactttacacaaagtataacagattttaaagattctgtcttttaactttttataaccttttgaaatctttatgtaatcatttgtgttttgatttcgtatataatataaagtcgtctttttgtcgtatttcgtcgaatcatatctttatttaacgaaatatatctatttttatctaatcagatatttttatgactttttaagttattcttattattaataaaataatacaaatgaagggggtattttatgaacgtggaaagtcttgttcaccgtcttggtatctgctccatatatcggggctattctttccttatttatgcagttgaactggcagttagaaatgaagaatatctgctgtacataaccaaagaattatatccggatgtcgcgaaacatttccattccaccagcacaaggatcgaacggtcacttcgtacggttatcaccacatgctggaatgaaggcaaccgaacgctgctggaccgcattgccggatatgaactgcagcgcaagcctaccaccggagaatttatttccatgctcgcttattatgtgagaaatcataaagatgaggaataataaaaagagacacagaagaagggagctggccggcaacggcgctcccttcttctgtgcaatagatttatataacagctttattccgttcaatatagcgcgtaacctcttcaagcgtaggtatggaggactgtgcccctttcctggtcactacaatggctgagacatagtttgcaaacactgccgcttctctcaggctttttccctcagcaagcattatagccaatgctgcggtaaaagaatctcctgcggccgttgtatccactgccttcactttcacagcgggaattctctcagcccctgttgtcttgtcatccaaataaacccccttttctcccaatgtcaccataacatctttgacaccctttttcttcaggcattcaaccgcttcctccaaatgttcctccgggctttcaatgcctgtcagcatacccagttctgtttcattcggcttaagaatatctacatagtgatacagttcttccgggaaatccttcggaacaggggcagggtctaatattaccattttacctagcttttttgcgatctcagcggcataacataccgtttccaaaggtacttccaactgaaaaataacaatatcgctttcttttataacatccaggttatcatcaatatcctgcttggacagcactgcatttgcacctgaaactacaatgatgctgttgtccccttcgctgtttactgtgatcagggcaatgcctgtactcacatcgtcctttacgatcaccctggaagtatcaacgccggcatcattcaggctctccatctggatatctgcatacatatccctgcccacggcacccagcattttcacatctgcacccagtttgcccagtgcacaggcctgattagcccccttgcctcctgcattcatctccattttcttgctgaggatcgtctcccccaccacaggtgtatggtccacctgcactgtcatatctaaattcaaacttccaatgaccaaaattttcttcatactgtcttctcctatcatccttttacacttcctgctgtgataccttcaacaaagtacttctggaatggaaggaacaggcaaattggaataatggccgagatcagagagctggcataaatgtatgtccactggatagaacgttctccgctgaactggctgatcgcgatctgaatggttctgatctccttggagcgcgctaccagaagaggccacatataggaattccactgattcataaaaatcataaggcctgccgttacaaataccgggattgaaataggcataataactttgataaatatagtcggccattttgcaccgtccacacgcgctgcttccaccagacttgggggaatatctttaaaaaactgaataaacaggaacgttaccaatccatccgcaattgccggtacgatcatacctgcgtaagtgtcaaccatccccagtccgttggcaacattatacagcggaatggcaatcgcctcaaagggaaccataaatgagatcagaacaagaggataaaaaatcttctttcccttaaactcaaaacaagtaaatgcaaaaccagccattgagttgatcagacatccgaagataatagaaaccactgtaacgatcatggtattcatgataggacgccagaactcatactttgtaaaaataatactgtaattttcccctgtaatttcagtggggatcagagactttatagtaaatggaaacatattccggaataaatcttcctgtgtcctcagagacgctgacagacagaagaaaatcgggaataaagacgcaattgtcataatcactaacactatgtatataacaactttcttagtaattcttttttgtctcagtgtcataacgttacgcctccttttctgtcagacatttattctgaataaaacatatcagcattacaataaccagcagaattgtaacaatacaagcctgtctgggtctgttggaatatttgaatgccgacttatatgcctcatacattaagacattggtacttccctgagggccaccctccgtagcaatctggattggcgcaaacagcaggaaattggctgttgtatttgccacaaacacaaaaagcagtgtgttttttaaaagcggaatagtgatcctgaacaatgtgctgaagaatccggaaccatctattttagctgattcatatacagccgtatcaattcctttcagtccggcaaggataaacatcatccaatacgcgcagcccctccaggatgcgatcaggacaatagataagagtgcccacttcttgtcaataagaaaaccaactggactgatgccaaaaagaccaaggatactgtttgccacaccattattgacattcagcatcatctgccagataacagtggcaatcgtcaaagagatacaaaacggcagataaaaaacagtcctgaatatttcgatgccgcgtacctttacattgaccatcatagccatgataaacgcgatgattatttgcagcggaataatgataacattaaattttaaagtaacccacagagaactccaaaatgttttatctgcaaacaacagtttatagttgtccagtgtaaaaccgccctctgttgaaagaactccctgaatcacactgtcaataatagggtaaatcttaaatatacagatcagaacgatcgtcggcagtattaaaagatacggaagccatttatttttaatatagataccacccatagtatcctcccatctttctaagtcatatcaatccatcaatttcacatgtcttatggtataaatggcggaataccggtcaaggcatgccgccatttaatctctcttgcttatttcttatatgctgctatagctgattcaaattgttctattgcattgtccaaagtctcttttacatctgcgccattacgtacatcttcccatgcctggtccaatactgtggaatactcaccaaatacaggtgtcacagcacggggaactgctgtattggcagcttcatatgcggcgatcttcatatccttggaagcatccgggtcgtttttgatctcgtcctgtttttccagacgactgggcacatcaccatttatatccagccacatatcgtttcctttttctaaagtaaaccatttaataaagtctgccgctgcatccttgttctttgaattggaattgataccaaagtaccagcttcctgtagatgtggctgctttgtcctcatatccctcaaagcatggtgcataagtgtatccaatttcatcatccgctttcatactcataggtgtccatgttccgcctatgataaacagcattttgcctgcatagaactggtctccaagctggtctgcgtcatatccttttgatgcaataccgtcatttaccagcccctgataccatgtcatcgcgttgatccacggttctgtatttacaacaccgtctaatgagtatccgtcatcactgatattttttccacccatggcgttggcaagcatattcatctgatatacacggcttacctgctgaaagtcaaagccgataagtccctgtgttccgtccggatccaatttttccagagcctgttttgccaaatctgccacctgctcgtatgtaagtcggttgttctcatcattttcaggtattgtgatgcccgccttatcaagtaatgtcttattataatacagttcctgtgtggaggtattctccggcgctgcatacatggtgtcttcccagacacctgcctgataggatgcgtcatcccattttgctttgtcctcatcggagaaatatttgtccaaaggctccagatatccgctggttccgtattttgcaatataagtaacatccacactcataacatcaaaatcagtatttccggctgctgcctttgtctcaataacttcaaataaatcattgaaagaatagaattccgcatcaatatggactcccgtctctttttcgtattcttccaatatcggttttgtgagcccttcccaggaatcctcaccaggcccctgagaaacccattttagagttacgctgtcggaatcaccttttgactctgtctttgcatcactgccgcctgcattattttttgagtttccgcagcctgcaagacctaaagaagctatcattgccgcgcttactgttaatgccagcacttttcttgttttcatattcttacctctcctttttttcggatatctgcttcagatacgcagttatctctttttcatgttctttaaaaactgtgattaaaaacaactgataaaatttaaaaacatccacctcagccgcataaagcgcattacactttccttcatgccaatgcccatcaatatccacgatggattgtcctctgccgattccatgttctataatatcaatatttgactcttttaaagtaaccacattctcatcgatcagatatgctattgtcaatatatcgtgcataggagaaaccattttatgcctggtctcccagttttcatccatacctgattccgtaatctggtatataaagcgggacaatttggtattaaaaatgcgaagcaattccctgcatgatgcgtcaagtgctatctgattcgtgacatccaatccaatcattacacatttcctgaatcccgactgaaaaacttctcttgcagctataggatctgcccaaaaattatattcagccacagggcttacatttccagtatatttagctccgcccatcaatacaatctgtttgacattacctgcgaatgaagggtcctttctgaccgctgaggcaatattggtacaaggcccaatagcagctattgtgagtttattcggattttctcttaccatcctcacaaggaaatctactgcatgttccttctccggctccttgtctgtcttaacagcatcggcacatcctccaagaccatcgtccccaaatgcatcaactgtgtcaggtcttacaccatttacagatgcatccgccccttgatacagtggaatgtcttctcttccgcaaagcgataaaatcttcaaaccattttgcgttgtattttcaatatgtccgtttcccgctacagaacatatggccagtacatcaattgccggatgatttaatgcaagaataatcgcaagtgcgtcatctacacctggatcacaatcaataattagctgtaacctttccatatattcccttcttctctattttgctagctttgcaaataaatcagcaaaaagattatctcttttgatatgatatacatactttataaaatgccggttattatcaaatgcatatctgtcatcatattcggggatcggactgtgtatcaggcaatcttcttcaaaatcaccatccagaagccatgcaacagcagtcacatcccagatagctctcgtccaggtggaacctccgtaacattccagcgcttcttttgtagtcacatccaccaggtaatcacacagtttattttttcctctgagatgatattccagttcaggaccgcttgtagtaaatgcggatacaacacccatacagggcagttgaaccagtggaacgccacagccaaatacgattctggcaccggctacatcctggaacaggttaaattccctgttatgaggccagtgaacagcatttcctcccagccagatcaaaactatcctgttcttgatctcaggatttatcaaaagcgcggaggagacatttgtgatagctccaatagcgatcacatagagcggattttcctctgaataatccatggctctctctgccagatcctttgcagcgtcagatattaccggttctgtctcggaagacatatatgaggttgaacctctgaagacatttgacttcaaatcttctctttccagcaatgtcaggatattcataatttcctgataactcttttccataccgtctgcaggacctgttgatttttcattgtggaagggagctgcatagattgctttcaaatttagcttctcatctgattttatcagataggcaactgcaaattggtcatcaatttcattatatgtatctgtatcaattaccacatccacttttcccttgggcttctgaagcctcataacaagttttgcatcatcttctttacatttttccactacttttgaactggtaaattcactccagtccttctgtgcttccttttttaccatattactcctttccttttcacctttctctgttatcccgccttaagaaaagtttttcttaaagtgttttcctatgcatgtattgtatctcacattttttatcctgtcaatattcatttgtttttttgttaaataaaactatttaggaaagtcttttcttgtgcatattgtatattagtagccgtttttttgctgtatcaagtcctatattcatattctattaaggccttggcatcctctttgaaatcaggaaactgtttttcaaaaaagagcttaaaaaacgctttgacatctaaatcataagccactttgcaatttttctttttttctttccatatatcaataggaaaaacaactgatgtcccactgcaaatcccatctgtctcaatttccacaaatgcctctctcaatttcaaaacagactcatcaatcagaaacgcggaaactaaaacatcacaaagctcacagcccaaatttctcagcttactccagtaactgtcaacatagatccttgtgatctgatggataaagcgggaaatgggcgtgttgatctgataaagtaattctctcatagcaggtgtcatgaaagcttttctagttacatccagtccgatcataactatttccttaaaaccggcttcaaaaacaatctttgccgcttccggatcaaaccaaaaattaaactccgcagtgggagacatatttccacaatgttctgcgcctcccatcaaaacaaccttttttatattttttgcgaaattttcatctttcaaaacagcaccggctatatttgtcaatggtccgatgggcatcaatgtcaacatacctttattctcttctgcggcccgcaccatatactcttctgctgtttctttttgaagtaaaatttcagctttatcaacttcaatatttccaaggccgtcatcgccatgggagctttcacatgataccgcttttctactcaaaggttcacttctgcctctataaactggtatgtcttccctctcacaaatctttaatatggtaaaggcattttgggttgcattatggatatccgtgttgccatttactgtagtcaacgcttcaatgcttattttctcaggtacactggctgtcagaaagattgccattgcatcatcaattccagggtctgtatcaatgattactctttccatgaataccatcctccttttctgtttcacaaaatctcaaaacacttattagtgataaagttctatgaaatcattttcgtaaattattttcttatgcatgtattgtactttcgccaaacttatctgtcaactattttttatttttttgttaattaaaactatttacgaaatctttttcttatgcacttttcacatatacttcatattttgccgttgacaaatctttccttatccttcataataaaagaaaaaattttgacgagggttctcatatgacaatcaaagaaatcgccagtctggccggtgtctctatctctacggtttccaaaatcgtcaacaacaaagacgagaatatcaatcctgagacccgcagccgggtactgaaaattgtaaaagaatataattatacaccatacggcatggtaaaaaatatatccagcgccaaaagctttcttctgggcgttcttctccgaactgcctcacagaccaatctaatgctgaacggaattctgcaggccgcacaggagcagggatataatgtgctgcttctggatagtctgaacagtgcagacacagagctgaagcatattacttctctctgtaaaaacaacgtggacggtgtgatctgggaacctgtagaggagaacagctcccagcatgaacactactttgcagaacaaaatatctctgtctgctatattaacggcgctgaaacactgcctgcttacaacattgattttgaaaaaatgggatatgtgctcacacagaaactgctggaatacaaacacactaagatcgcctgtcttatgaaagaaaagagcagacgttccggcatggtgtttgagggatttaagaagtgcctgtttgacaatcagatcccttatcatgacaagatgaagcttttcatctctgacccggcctgctgttctaaagttctgagccacggattttcaggaatcgtcagttcacattttgcctcctccctgatcctgtatgaacagatgaacaagctgcactactacgtgccttctgacttatccctagtcagtttaaaggatgatgtgcgggaggccatctccttcccccacatatccagtatcaaaatcccttaccgggagtttggatactatgtctgcaaaaatctgatccaaaaatgcgagaaaaagcagacggaagaaccggaatatacctttgtctcccagtgcgtttttgacaaggaggacagtctggacatcccctccttcttccgtgccaaaaaaattgttgtggtcggaagcatcaacacagatatcaccttcaacgtagactggcttccccaggcaggtaaaaccactactattttaagctccaccaccacactcggtggcaaaggcgccaaccagtccgtaggcgctgccaagcttggacgcgaagtatcccttataggagagattggcaatgacacggattccaccttcatctttgatatactggaaaaagaacaggtgactacccagggtgtgcacagggacatgaaggcacagacaggaaaagcttatatctatattgagcgcgacggagagggaaccatcaccattatgtccggagccaacggcaacctcagcccgaatgacatacagaaacgacagcatctgtttgaaaacgccggtttctgcctgctctccactgaaattcccattcaatcagttctggaggcagccaaaaccgcaagaaaatacggtgccaaaaacatcgtcaaacccgcagctctgaaatccatacccgagcagcttttacagaacacagatatctttatacctaaccgaaaggaagctgccgctttgtgtccccagtacggtactgtggaagaacaggccgactactttttccggaaagggataaaggctgttatcattaccctggggcatgagggctgttatctgaaaactgcagacagcgcaaaatattttccagcggcggatttcatctccatagacactaccggcggcgcggatgcttttatctcagcactggcctcttttctgatcgagggctattctctggaaaaatccatccggatcgccacctatgcagcaggcttctgtgtttccagacagggagttgtccctgctctggtagatcacaacactttagagactcatatcaaaaagctggagccggagcttctaaagtaacagtatccttcagcagatagaaaggaaaagttgacttttccgtcatttctggtaaactaaacaaatacggtaacttccgcaaacaggagatgacacatgaagattcgacaaaagaaatggttgtacgccgcggtttttatgacttctgctctgctgctcacaggatgcgtcagcaaagaggagcgcgcagtaaagcagacagtttcagcggaacttgaccagctaaaaaaacctgataaaaagaccattgaaaaatacctgtccatacgtgagcttttccctgacaagggtacatctgaaaaggacaatgaagagggcagcgtagatcctgacattgcccaaatctttacgcggtattttaaggatttttcttacaccgtagataatgtcaaaatcaaggacacaaaagccagcgccactgtcacggttaccaatctggatgctcatgcccttgctgaggattacacagccgctgctctgaaaaaacggatcacctgtgacgccaatcccagtcaggtagaattttcgctgaaggactcttacctgctccttggagagacactgaaaaaaaataagtataaactggtggataccacctttgacctgaaactaaagcaaaaagacgacacctggacgctcgtccgtagtgaagacctggacaatcagataaccggcggttttctcacttatatggcagattctgatctgctgccgccccaggaagtagtcaaaatacattttaataccatcaaagaatttgatacggaacagctcaacatctatctgtctctggacagccttctggatacagatgacacttacagcagctctattgcacacgcaatggcggaacagatccatgcctgctttgattttaagatcctggattccaaaaataatgaacgcaatgctctggtgaaggttcagataaccagcagtgattttaaaagcattgtgtcatcctaccaggaacagctatccgggtggctgcagacttcccaggccatggcaggcggcgcagaaggacgccgcgagaaagaacggcagcttctcctggaaagcatagaaaagaacaatgcctccactacccgagaggtggacatcgcccttgtaaatgacggaacaagctggaaaatgcagatggatgaaaatgttgcattggccatactgggaggtgtggacagcgctctggcggatgtgtcagaagatgtggaatagaaaacagttgcccggtctttgttttaccaaagatcgggcatttttcatatgaaaatcaggatgaaatttttattcatttgttggcagcaagacaacagccaactcttttactgctcatcctcctgcaccttcagtgcaattcccagttcatccagttgtttttcatcaacctggttgggtgcttctgacatcagacaggaagcgtccttcaccttcgggaacgcgatcacctcgcggatggattcctcttttgccatgagcatgaccatacggtccagaccgtaagccagtcctgcatggggcggaactccgtatttaaaggcatccagaaggaaaccaaactgcttgtacgcctgttctttttcaaatcccagagcctcaaacattttttcctgtacatcgttctgatggatcctcacactgccgccgccgatctcgttgccgttgagtacaatatcataggctttggcgcggactgcacccggatctgtatccaaaagaggaatgtcctcctcaaaaggcatggtaaacggatggtgcatagctgtgaaacgttcctcttcctctgaccactccagaagcgggaactctgtgatccatacaaaacgatactcatctttgtcgaacagctccatctggcgtgccagttcaagacgcaaagctcccagtacatcccatacaagcttggtcttgtcagccgcaaagagaagcaggtcaccggcttcaccctgcatagcttctatgagagccttcatttcctcctcctgcataaattttgcaaaggaagattttacactgccgtcctcttggatggcaatatatgccaggcctttagcgccgtaacccttggcgaactccaccagcttatcaattttctttctcggcatactgccctgtcccttggcattgataccacggacactgcctcctgcctccaaagcattcttaaacactgcaaattcacagccttttaccacttctgacacatcggtaagctccatgccgaaacgcagatccggtttgtcggaaccaaaacggttcatggcctcagtccaagtcattctctggatcggaagctgcacttccacacccagaacctctttaaacagaaatgccagcatacgctcatttacatcaatgacatcatctacatcgacgaaagagagctccatatcgatctgtgtaaactccggctgacggtccgcccgcagatcctcatcgcggaaacattttgcgatctggaaatatctgtcatacccggaacacataagaagctgtttaaatatctgcggtgactggggcagcgcataaaagcttccgggatgtacacggctgggaaccagataatctcttgccccctccggggtactcttgttcaagattggtgtctcaatctccaaaaagccttcatttgccaggaactggcggaccagtacagccacctgggagcgaaggatcaggtttctctgcagatccggtctcctcagatccagataacggtattttaagcgcacttcctctctcgtcttgctgttctcctcaatggggaagggaggtgtctcagactcagaaaggatacgcagagcattggcgcgcacttctatctcacctgtttcaagattttcgttcaccgcaccggaacgtgcctccacgcggcctgtcacagcgataacaaattcacttctcagtcttccggccttctcaaagccttcctcatcgatatcgccgttttcaaagatgatctgcatgataccggaacggtcacgcaaatccacgaagacaataccgcctttgttgcggctcttctgcacccagcccataagggttaccgtgcttccgatctctgcttttgtcacttccgtacatctatgggttctctttaacccgttcattgattctgccattgtgtcagttctccttcacttcctagttgtatacctcttcgatgatttcatatccctctgccatgagctgttctttctggaattttttgttcttcttcatgtatacaatatttacattcttaccggattttctctcttctccagctttcttcacaatctcgatcagcttttcagaactcagcttcttatccagcagatatgctttcttatccatgctgcccggaacctggaatcctctctccataagcagcattacaatacgctcaaaaccaatagaaaatccggttgccggagtcggggttcctgtaaatttgccgatcatttcatcataacgtccgccgccgcctacgctgccggcaaagccgtcgatgcagatctcaaaaatcggtcctgtgtaataggacataccgcgcaccagtgtggggtcgaatacgatcctgaagttggctgtcttagcctctgtcacgctctcaataatagtggacatattgtctgccacatccgggtccaggaagccttccagcttctctttacagtaattcacaccgtcaatgccttctccaatggcatcaaataaagcaatatatttgtcaatgccctctttggggaatcctgattcctccagttccgcagccacaccttccttgccaatcttgtccattttatccaggatgatgaatacctggtcataagactcttccgggaatccgctgtaagcagccatggcttttaagaaacggcggtcattgatacggatcgcaaagctctcaaattccagcttgccaaccagtgtggaggttgccaggataacatctatctccgccaggttagtagggtctcctaaaatatcaatatcacactgcataaactgacggaaacgtcctctctgcggtctatctgcacggaatacattgcccatctgcagagccttgaaaggagacggaagttcattggcattgttggagtaaaaacggctgaggggaaccgtcaggtcatagcgcaggccgctgtcaaccagatcattctcctcttttgcctcatcgagcctcagcttttcccctcttttcagaatacggaaaatcagtttttcattgtcaccgccctgcttgctggtcaggttctcaatatgctccacacagggagtttccatggatgtaaatccaaactctttgtaggtctccttgataagtccaatgacataatcacggatctccatctctctcggcagaatatctttcattcctgtaactggttttttctttaactgcataattttctctcctcttctctaatcatttcgtaactgtttggttccttcacagttcgtcctcttcatgtattgctctttgaaacgcaagaaatacctgcatatcaaaattcttgacttcatcgatcaccatcttcacagcagtctcgccggaaaacgcgtcacggtaagctcttttggaggtgagcgctgcatatacatcacagatcctcaggatcctggctcctaagggaatcttttcccctgccaggttctccggatacccgcttccatcgtaattttcatgatgatagtagatgctctccagaacaaacgcagaatatcccctgtccttcaggctctcatatcccagttccgggtggcgccttacatacctcatctcctccaccaccatgggattctcctccccggcaatgtagttgtaaagccgcagcttccctatatcgtgcagcactccggctactgccagttcatgacaggtttccccggaaagccccatctgttttcccacacggaaggccaggttgctcacctggataccatgctcaatttctttttccagattgaagctaatcagatgcttctgtgtgtttgccatttccgcagtccccgctctttatattcagatacgtttccagcccaatccgttttctgtccatcatttcatctgttctggtgatataatttgtcacatcttttacattttcagcgcgctctatacgctcgccgttttgaaatacaaacttggtagaggctccagcccctgctgccaaaatggactgcttctcttccatgatcagaatattatagatgcctgctttgcccggctttgcgtatcccacattctccaggttgcctgacatattcttctgtctgtacagataatatggtcccataccgctctgccgtgcatactccatacacatatccatgatttcctgattgttttcaaaggtcatctcttcgtactgttccttgaacagatgaagcctggtcgctctttttactgccagtgaatgtacggtcaggctgtccgggtccagagcctttatctcctccagagtgtgctttacatcctgcgcacattctccgggcagacccacgatgagatccatgttgatattgtcaaagccgcattcccttgccaggaaaaaagcgctctttgtgtcttccaccgtatgtttccgaccgatcagatccagtgtcctctggttcatggtctgagggttcacggagatccttgtcaccggatgccttttgatggccatgagcttctctcttgtgatactgtccggtcttccggcttctacggtgtattccttcacctgctccacgggaaagcacgcttcaatatgggtcagcagtctgtctaactgctccggctccaatgtggtgggcgttcctccgccgatgtatatggtgtcaagggtacgcactttcatagtctctccaatgtaagtcagttccctgcagagcgcgtccaggtattcatccactttgtctctccatctcgctaaaggagatgagctgaaagaacaatacagacagatactggggcagaagggaatccccacatacaggctgtacccgttctgataatcaatatcttttaacagatcccgttcccggttggctatggtgaccgccagcgcagtctttgcattgctggtataataggtacggcgcatatagtccgcagcctccgcattgctcatccctgactcaatcagccccatggcgatcttggtagggcgtatgcccgtcagattcccccagggaagggtaatgcctgtctcctgcacaagccctctgtaaaggatctgtttcagtatgttttttctctcttttctttcctgccctttttcaaagcgggccgcttctccgaatataatttctccatccctctccaaggagaggtgggtcttatcatccccgtaggtgattctcaccagcaggtcataggctttcttctcctcagcgtcttcctcatagaaattctccacttcttcttgaggatagaaagccttgacaagggtgtaagcatcatattcaaactctcttttattaaatgaaatgccaatcatataggctcctctttcctggattttttatagatagggattatatgatcgctcatgatggatgctggtctcctccccgtgtccggggtaaatcttcacatcctcaggtaaatggttaatgatcttatccaggctctcctgcatttttgcaaaattgcctccgggcagatcacatctgccgcagttttcacagaaaatggtgtccccgctcatgagtacaccttcgtcctcaatataataacagcaggagccttccgtgtgtcccggagtcaggtacattttgatctgaaatcctgccagttcaaaaatctctccatcctccagcagacagtccgctttcaccgtataatcaagcccttcccaggacgcagacaggttcatctgcgggtccgtgagcatatcctcctccgctttcgccgcatagacaggcacctgccacttctcctttagttcacccactgccataatatggtcataatgtccgtgtgtcagaagtatccctgccggttttccctcgattctctcaacagtgcggcagatacgctccgcctcagccgcggggtcgaccaccaggatctccccgctctgtgtatttttaaggaaatagcagttggtcatgaccggaccaaccacgatccctctcagattcagattcttcatatatattgactccttagcctgtagtacgtccgatatcaaggacgctctctacctgtctgattttttccaccaggctgcccagttcttccttgctcttaatatcaaaggcaatgtttatggtggcacgcccctgtttgctggttctggtattcatggacgtgatatctattttcctctccgtgaagattttggaaatgtcaaccagaaggcctgtgcggttattggcatacacattgatctccgctgtgtactgctctccgtctcccgcgctctcagcctgccactccgcatcgatcagccgttctctgtcttctaaggacatgttgatgatattgatgcaatccgtgcggtgaatggtgacaccacggcctctcgtcacataacccacgatctcatctccgggaatagggttgcagcatctggaaaaacgtacagatacatcatggatcccctttaccacaatgccgctcttgctcttgtggatgtggagtttctcccggctctcctccgcagcttccagaaccttctcgtctgtcagttcactcttatggtccttggtgtagatctccaggagcttgttgatgacctggccttctttcagtccgccgtgtcccacagccgccagtacggaatcccagtcacggaacccatatttcttcatgacggattccagatatttgggttttgtcagattcccaagcccgatgccttttaattttgcgtactgggtgagcatatctttgccctttaaaatattgtcctcttttaactcctgcttgaaccattggtttatcttattcttagcctgagtgctcttcaccaccttgagccagtcacggctggggcctttggagttctgggaggtgatgatctcgatcctgtccccgttcttgatcacatagtcaatgggaaccagcttgccgttcactctggcacccaccattttgttgccaactgcactatgtacattataggcaaaatcaatgggggtggaaccgtttggaagtgtcttcacatcccccgccggtgtaaaacagtacacgctttcggaaaacagatccaggtcgcttttcaaaaggcttaaaaactccttgttgtcggacatgtcccgctgccactccagtatctgccgcagccagctcatcttctcctcttcctgctgtgtcacattggccttactgctgcctgatgcctctttatatttccagtgggccgcaataccgtactctgcggtgcggtgcatctcaaatgttcggatctggatttcaaaaggatgtccttccggcccgatcagcgtcgtatggagcgactggtacatgttctgctttggcatggcgatatagtccttgaaccttccggggataggcttatacatctcatggatcactcccagagccgcataacagtccttgaccgtatccactttaatccgcaccgcaaacagatcataaatctggtcaagagtcttattctgattcaccatcttcttgtaaatactgaagaaatgcttcacccggccgtcaatctgggcatggatgcctgcattttcaatctgctcccggacgccgtttacgatgccgctcacaaaagcttcccgctcactcttccgcaggttgatcttctctaccagatcgtaatagacttccggctccagatattttaaggacagatcatccagctctattttcactttagaaatacccagcctctgggctatgggagcatagatatccatggtctcccttgccttctccttctgcttgtggggaggcatgtatttcagcgtcctcatattgtgcagccggtccgcaagcttgatcaaaataaccctgatatccttggccatggcaaggaacatctttcgtaaattctccgcctgtacctccaccttatcggcggagtaatttaattgtcccagtttcgtgacgccgtccactaacagggcaacctctgccccaaactcctgggtgatctcctcggtggtcatgactgtgtcctccaccacgtcgtggagcaggccggccacgatggtctccttgtcaagctccagatccgccagaatgatccccacacagaggggatgaatgatataaggctcgccggacttgcgcacctgcccttcatgggcatctctggcgatccggtaagccttctcgatcatggaaatatcggtggagggatggtacttctgcacactggaaataagctcttcatataaaacagaagggcttgtaaaatcttccattgtcttcacacttgcatctgccttttttatcttcgctatttcatcatcctgaagtgttgcctctttacttttctccatctgccatcacctgatttctatttaccttcataacatataacggaagccacatcataatctttcaaacgctctctgccgttcagaccggccagttccatgagggatatgatcttcactaccttccctccaagctcttccaccattctggcagtggcttctatggttccgcctgtggctatcagatcatccaccagcaccactctctggcccggtataatggaatccttgtgcatctctatagtcgcacttccgtattccagctcatagctgctctctatggtctcacagggcagctttcctttctttcgtatcagtacaaagggcttatgtaaattgtaggcgataggtgccccgaatataaagcccctggactctgcgccggcgatcacatccacctccaagccgtccaaaagggcctgcatggaatccactgccagtgcaaatccatctgcatcctgtaatatgctggtcacatctctgaaaatgattcccggttcaggaaaatccgggatactgcgcacatattcctcaatcttcttcataactctctcctgcctttagtttcatttgattatctcattatatgtcaattatactctaattttaggtgtagtctttagtatatcatctttttttgtcggaatcaaatataattttgtacgataatttcaatactttccctgccattataggcatttatggatggatagtatgcaactgaccatctattcttctcttttatacgctccgcaaaagcatcaccgtctccgaaccatacaccctcggcctcacatccgttctcgtcgtaaagcttcatcttcaccacgtttctgttctttccaaagacacggcagttttcaatgcggacatttttctgggcaaacaatggcttggtatttccttttccgaaaggctccaaaagggaaagctgacggataaggggcatattcacataggagatgggcatgggcacgtcgatcagcaccttttccgccatatcctcctcggtaagagtacagttctcattcagcatccgccggaagggttcaacattttcctccggaagggaaagtcccgctgccatgggatgtccgccgaatttggcaagcagttcccggcattttgtaagctcccggaacatgtgatagctctctatggaacggccggagcctttgactccctcctccgccttagtaagcacaaacaccggtttgctatagcgctcccggatacggccggcaataatgcctgccagactttcgtggcagtccggcagatagatgacaagcaccctgtcctcacgaagggaagtgttctccaccatctctgctgcttcctccacacccttggccgtcatgtcttttctgctgtcattgagtgcttttaagtcttctgccaaagccgccgcttcctcccggtcacggcaaaggagcagattcagcgctcttttggctgtgctcagacgaccgctggcattcatgcagggaccgataacaaaaccgatgtgatatgccgtgagaggcctgtcctccagattattgacatgaatcagggcttttaatcccagattctgtgtgtgggcgattcttttcaatccctcttttaccatgatcctgttctcatcctgtagatccatcacatcccccactgtggcaatggctgcaaattccatgagttcctccagatccgaagccccgaatcccatgcgctcataaagtccgcagatcactttgtaagccaccatagccccgcagattcccttgaatggataagggcagtcctgctgctttggatttacaatagcattcgcatccggaagaaaagtccgcacgcttccgtcctccagctcctcatagggaatctcatggtggtctgtcaccaccacagtcatgccaaggcttttggcataggcaatctgctctatggcgctgataccattgtcgcaggtcacaatggtatctgtacccgcttcaaaagccaggtcgatcagctctttgcttatgccgtatccgtccttcattctgtcggggatatccacatccacacaggctcccgcatggctaagtccggtgagcagaatgtaagtggagcatacaccgtcgatatcatagtccccgatgatcctgatctttttcccttctcttatcttatccagcagaatatcaagggctgtgtccactccttttaaaagcttccaggaatgaaggcctgacatctttccgtgcagatatctgtcaatctcctcatctgttatctggtccctgtttcttatgagcctggcaatgaccgggtccactccaaattttcggcttatttcataaaaatccgctttcttggcggaaatcacccatttttccatcttatgtattctccttttcctatacacatcgcatatcctgcccggagggcttttctatgtaataagaaaggagcgctgctgtgcagcacccctctccgtatttacgcatatttctttttgatcttcgtcttcatgacataccacagggcacctgtgatgcatacggaagaatatccgccgcacacaataccgaccatcagcggcagggcgaattctcttacagaggagactcccatcacaaacagcaggaataccatgataaaggtagtcagagaagtatagatacttctcgtcagagtctgggtgatactgctgttgaccagctcctccatatccgttttctttttggctgctgccaggttctcacggatacggtcaaagataacgatcgtcgcattgatcgagtaacccacgatcgtaagcatacaggcaataaaggtattacccacggatactctggctactgcatagaaggccagaactaccagcacgtcgtgaagcagagccacaactgcgctgcttgcgaaccggatatccttgaaacgcagccagatgtaaagcagcataaggatggtggcgatcaccacggcttttaccgcgtcggcacgcatctcactgctgacagtagaggaaatactctccgttgcgatcagatcctggtccacgccgaacttgtctgccagtgcctgattgagagcttcccttgtctgtacatccagagtgatggtcttgatgataacctgattggtacctaccacttttgtggcctgtacattgttgtcaccggtaacatcctccacaaccgggatcacattggcatcaatatctttgatatccatattttcattaaaggttacattggtggaggtacctcccttgaactctaagctgtatttcagtgcgtccccggtgctggctttaaatgcgcccatggcgataggcgcacagaggatcagaatgccggaaaccacaaagaagatttttttcttctgcaaaaagtgaatcggctgtctttccttctttctgccgtagaatttttcatcacggattcccacagcgtacatggcatatgcaatgaaacgggaaaccaccagtgccgtaaacatggacagaacaataccaagtgccagagtctgcgcgaatcccttaactgtaccggagccaagccagttcaatacaaatgccgcgatcaaagttgtgatattgccgtcaaagatggcagaaaacgctttctggaaaccattctgaatggcagtccgtacatttctgcccagagctatctcttcctggatacgggcgtatatgataacgttggcatccacagccataccgatagacaggatgatacctgcgataccgggaagtgtcagtgtaaggtcaaatgcattcaggcagatcagatccaggcatgtgtagatgatcagcgcaatgccggagacaagacccggaatcctatatacaaaaatcataaacagaatgaccagcgcaagaccgatccctgcagctttcacactgctggcgatagcctcttcaccaagctgtgccgcaaccacattggaacgcagctcgctcaactccagtttcagaccaccaatacggatcgtggaggccaggttctcagcctcagcagaatccttcatacctgaaatctgggcattgccgtctttgatctctgcatttacattgggaacgctgacaaatttgccgtcataatagataccaatgctgtcatggctgtcttcaaaggctgcttttgtagcctctgcaaattttgtggttccctcctctgtcagcgtcagatccacaacattttctttgtttttcaaatcgttttcgatcatggcagcttttgctgtcttaacctctgtacctgtcagcacaatggaaccatcttcctgcagttcctcgatggtcttattcagcacatactctgtaccgttatagctgtagttctcagaaccgtcagcacccttgtgcgcaataaaatacagggaacccggttttcccagctcctccaggatctggttagcatctgtcacgcccggaatttccacgttgatcctgtttgtgccctctttgtaaacctgggcctcggagctgtactgctccactcgtttttgtaatttgtagatggtatctgccatctcatcatctgtggggttcttttttgatgcctcgtaggttatactgacaccacctgccaggtcaaggccggtcttaatgtgtttggcagcacctgttccggtgggacccacaccaactgcggaggtgaataccagaaaaccggtaatcagaaccgtcagcacaagtacgagaatacctctgcttttcttcattgttctttcccttctttactcttagtcttaatctgtgtcatgctgtgatcgctagtatccacgatcccgtcagggaatttccccggggacttactgatctgccatggccgcttttatcataatggcacattccactctctttcgctgcagttcacagccaagatcatagacatcattgatagatccgtggaaattataggaatttgccgcgcatccgccgctgcagtaaaatctggcgaagcactcccggcatttatcctttgcatatacattacactctttaaactcgtcacggatttccggtttctgtacaccgtcccatacgttgcccatgaggaatttctcctcacctacaaactggtggcatggatacaggtccccccatggggtcacagccaggtattccgttccggaaccacagccagaaagcctcttgtacacgcaggggcctcccgtcaggtctatcataaagtggaagaaattaaaacctcttccctctttttccctcttgatgatttcttttgccaacttgtcatactcttcacagatcttcggaacatcttcccactggagtgcatatgcctctttttcatctgccaccacaggctccacagatatctgttcaaagcccagatcagccaaatggagcacgtccttggaaaaatccagattatgacgggtgaaggttcctctggcataatatcttttctggcctctgctgtccgcaaacttctggaattttggcacaaccaggtcatagctgcccgctccttttctgaaaggacgcataaaatcatggacttccctgcggccgtcaatactgagaaccacattgtccatctctttattcgcgaactccattatctcatcattgagcagaacgccgtttgtagtcagagtaaaacggaaatgcttgttgtggattttttcctgggaacggccataggccactaggtctttgacgaccttccagttcatcagaggctccccgccaaagaaatcgacttccagattcttcctgctgcctgaattggcgatcaggaaatccagcgcctgttttcccacttcataagacatcatggctctgcgtccatgatactccccttcctccgcaaaacagtagcggcatgccaggttgcagtcgtgggcaatatgtaagcacagggccttcaccacagtaggcctgtccttaaaactgttgattgctttctcgtacacatcctctgtaaacagcatctgttcttttttcagctccgcgcattcctcaagagcagtcttaatatcctcctcctgatacctgccttccagggaagcgagtatctccttctcactttttccctcatcgagcagtccaaccatatcgtaaacgatctcatctaccacatgcacggaaccgctgtttacatcgagtacaatattatagccattatttttataacgatgaatcacagtgttttccctttcttctcttgcagatcattaaaatccacatgctgaaattgtttcgagactcctccctcacctgcgaaggccggaaggttccccgctgttcatgctgaacaatgaataagcagcggcttttataccgctgcttttgatgtcttcctatgacagcaaactactttttataataggaagcccgctgagtgcggtttctattatttattctcgcagctctggtttcctacggtgcaggatgtcttgcatgctgactgacaggatgtctggcactcaccgcatccgcctttctttactgtgttctgcaagctttttgtatttaatgttttgatatgttccatgacatattcctccctgtgcttaaatgtaattctatgcgtctgcacgcttgtggctattatagcatatctataaccggcaaggcaagtatttctttcgtaattcaggacaataaggtaacagttcagccttccactttcccgcgaagtgttgccttgcattcgcaaggcaatcctgaggcagtcacgcgccagactgcggtttgtgcagtctgtgtgcatacttttaataaggctgaaccgttacgacagcataccgcccagcgcgcctcccaggaaacagaggaaataggtcactgccatctccttgaaatcagcggttatctggtgctccgtcaaaaatgtgaccgcggtgagaagcactgcatatccgatccccagcgccattccccaaagatatctctggtttcccaccttttttccaagataaaatcctcccagaaaacaggacactatgtaaataatcaaaatgcccagatttacctggttttctcccagtcccatcttgtacagaagaagcgccagaagaagcagcataaggcctgttgccaggtaagccgccagcagcgccttcatcatcagtagaggttttgattgttttacaactgtctgctccataaagaaaccctcccatatgtatatatatgggaggggattctaatgtattactatgtaattgcttctataactgttccaagctctcacagccgcctatttcttttttcttttgctcaggaccacaaggatcactaccacgatgactgcggccgcggctgccagcacataggtcaggataggtgtctcatcacctgttctgggatttacgatgacagtaccgttatttttctttactgaggtatccacaggcttcttcactgtggaagaactgccgtttccgttatttttgttgacggaagaacctccgctgttaccggtggttcctgttgacggcactaccggtttatggttcggactctgtgtaccgattcccacaagctgactgccgcccacattaaaaggactcagagagccggtctcaaacaccaggtatccgtccacaacattcatattgcttcccagggtaaaatattcgtaatttcctgtctcttcgatataatgtccgatcaacagcttcttatagaggtccgcgtcttttggcaccggaattgaaactgtgacttttttgccgtccgggatcgtgtattttttatctgcttttaaatcccaaagctttatctcataggcctggaggatctgttcaatatccgctttcggcatgctgtccagatctgtattcactgaaaccctgacttccacataggacggaataaaatcaccggatattttaacatctgtggctttgtcccaaagactgcccaccggttctttttcggaagtatcttccttcttggatgtgtcatcctttttatcagagccttcttttttcggcacttcttttttagatgtatcatcctttttgtcttctacgtcttttttatcatcggttggcttttctgtcttatctgggtcttttttatcatcagccggcttttccgtcttatcggtgtctttcttatcggtatctgtattcttgtcactgccgttaggattttcagccgtttcacttttgcccgtgtcaccgctgcctgtatccttcttaggatcttctgtggcgctttcgtccttcttgggctcctctttatcttctgctgaaggctccggcgtctttaaagactccacatacaccttcacgcttcggattacctgctgtccctcctggctccagccctgaattcctgaataatcatatgtctctgtatcatttggtgtaaaaatgatctgctgtgtactctcgtatgtatcgggaatcttctccggctccgcaaagcggaaggtaccatccccttcaaatccatcccccatgaacatagactccagcgtagccggctctttcatcgtcatggtatccggaactgtcactgcgggagcttcctgctttttggccggtgtctcttcttttggctcttcctttggttcttctttttgctcctcttttggttcctctttggtctcttcctttgattcttcttttgtctcttctttatcagctttatcggcgctgttatccccggaaggattctcttctttcttctgttcctggctgtctttgctctcctcttttgctttttctcccactacaaaagcgtctgcacccagatttgcactcttagtatccacatcggaggcactcaaccatccgtaagtcaggataagcttaccgctcccctccacttttataattggaccgctgaatccgtcagcacgcttcactgtgattcccgacggcatggcgagctttgtctcaccggagatggttatggtcccgcataccaaaatggttccgttgtcagcggccaaggacttggctttttcaaagctggacactgccgaatccttagaagtgccgtctccgcctttcttgccgctgccgctcaaatagactgtttttaactttgccgtgttgtctgactgctccgctgccgctgcctgggacaatcccatgtgcataccggtgcccactccctgtactaccagcaccgctgccagggtgatacccagtgtcgtttttaagattctatttttatatgatctgctgttatttttcttcatactctgcccctttttcaaaactgtcttgtcatggtctgctctgagcaacagttcaggcaagctgaaccgttacgcttctctatcttttatatgtaaaaaccgccgttctgcacattgtgcatattagacaatttaggtactctttctttaggcataatcatcatgcctctatcggagtcattatagcatatttctgtatgtttcgacacccctaaaattcaatttttttattttttctgctatacttgcaatccttcccaaaatcatgtatcatttcttaatataattttatattacaaaggagttgaaatttaattggattccagtgacgccatacagtttctcgttttgatcattctcatatgtctttcggcatttttttcatccgcagaaacttctatgacaaccgcaaacaaaatacgtatccaaaccctggccgaacagggaaacaagaaggccaaaacccttctgaaggtaacaggcaattccggcaagatgctcagcaccattttaatcggcaacaacctggtgaatattggggcttcttccctggctacatccatggcgatccgtatgttcggcaacgccgcagtgggcatctgtaccggtgtgctcacactgctcattttgattttcggagaaatcacaccgaaaaccatggcaaccctcaatgcggaaaagcttgcactttcttatgcaggaccgatccatggacttatggtaattctcacaccggtcatctatattgtaaataagctttcagacggcgttctctcccttctgcggatcgaccagagcggaaaaggcaaccgaatcacagaacacgagctgcgcaccatcgtcaacgtcagccatgaggaaggcgttattgagagcgaggaacgccagatgatatacaacgtgttcgatttcggtgattcccaagccaaggatgttatggttccccgcattgatgtggcttttgctgatatcggaagctcctatgatgacctggtatccatgttcagagaggaaaagcacacccgtttccccgtctatgaagataccacagacaatgtggtgggcattgtaaatgtaaaggatctgctgctcatggggtccagggagaatttttctctcagggagatcatgcgtgagccttacttcacttttgagtacaagaagacctctgagcttctggtggaaatgaaagaagagagtgtttcctttgccgttgtacttgacgagtacggcgcaacagccggaatcatcactctggaggatttgctggaggagatcgtgggggatatccacgatgaatatgatgacacggaggaggacgacctgacggaaatcattccgggacgggaatatgttgctctcggctctgccagactggatgatctgaatgaggtgctgcctgtacagattgaatctgaggactatgattccatcggcggctacatcatcgaacagcttgaccgcttcccggaacccggggagagcatcacaaccccggatcatgtccgcctggttgtggacaagatagagaaaaacagaattgaggctgtacatatatacctgcccgagatacaggaacagcccgaagaagaagaatgacaggtaactggaaggaatacccgacagctgccgcgaaaacaccaaatggaaaggacaacaaagaattatgagcggttttcttaacatggacagccccgttatgcggtttctgtcccgcgtatgtgacctgatgatcttaaattttatgtgcctgatatgctgcattcctattgtgaccataggagcatctgtcactgcgctttactctgttactctgaaaatggtaaggggtgaggaatcttacatcttcaaaggctttttaaaagcattcaaggagaacttcaagatctctacgatcatctggctgatcctggctgtactgggtctgctgatcttcgccgattacaaagcaatccagtttttgcctgacaatatgaagaacatcttccgcattctggtaggcgttgtgataaccttttacctcctgctgcttacctatgtcttcccctatgtggcaaggtttgagaacaatgtgaaaaacactattaaaaatgcgctgcttatcagcatcctgaatctgccccatacgattttggttgtctgtattccggtgggaatcgtgttcatcaccatgttcaattccactacacttgtttacggaagcctattctggttcttgatcggactctcctttattgctttttgtaattcctatatcttccgcaaggtttttgcaaaatatgaacccgcggaggaggaagagcagggcaatccggacgattatactgttcctgaagatgaaatttcctctaatcaggagacaatagaacaaatccaggaaaagaaataaatcctctgacaaaagaaagggctgtgaaaaatggaataacatttttcacagccccttcttttattcatttctcatatttttcagtatctcatggaactgttccccacagcgggcgatctctcccagaacggtctcacatcccttttcgcttaaaaaccaattgtccctggtgatctcacagtcatctgcaggacagacaagaagctctgtctccggataaagaagctggtaatacagaagcgcgcgcctggcatgtgccggtttgcagcagatcaatccacgtttcacctcaagacctgctgcgtctgtcacagctctggaacggatggcattctcatatgtataggttgctttttcctctctccatatatcacattctctcacaccatttttcacaaggactgtctttaaaaattcccactctgtcctgtactctccatcgtactcctcttcttttgcccggacccctccgaattttccctgcagaatgctgtatttccccgacggcagaacaagggaggaaaacccttccccatacagttctgccgctttttctgcgatctggggaaaaccactgccggggacaaagataatatctgccgttttcggttcctgctccacaaatatgaactctgtcatctggtccaaaaatctcttgttaaacattattcctgtcctctttctgctctgctgtccgtttccgcattgctgtacaggtacttttccgtgatcagacaaaggaaatccagaatctccgggtaggtaaaaatttcttctgtccgtatcatgtgctccagttcccctgctgacacccatctgacctctgccacttcatccggatccagaatcagctccccggcaggtatatccctccgcgcgagaaacacgtcccagatcatatggcttccatcttccctgttaatatgtgccagatgtatcagttcttccctattaagttcaaggccgatttcctctctgacctccctgatgcagccctctttagcatcttcgcctgcctgtatccttcctgctgtcagagaccagacattgggatagtgtacacatctgctgcttcgtttctggattagaaattctcctttgctgttgatgatccaggcctccactgcaatatggtactccccatcctcaaaagttctgcccttttcaatggtcctccccgtagggatccctctgctgtcgcgtatgtcccagagttccatcatgtatcctcctatctaccgaatgtcatacacacttctgagccgcaggttcttaggttcgcctctcagtaccctgacgcgcttctccccggcattcatatcaaaatagttatccgacaaaagcagatcttccttatcattctggatctccacactcttggcatacgcctgtgcccggataaggatctcattcccctctacccggcagctaagttttggatcttcataggcaaagtattttggcagagagaagatcaccgtaccttctgagatgatgcttccattctgcaccagctcatagcttacatagttgtcaaatatctgaatatgcggaaactctgtcttgtcaagccagatactggacataggcggaacactgaccatctcctcccgggacgagatcatctctgccttttggttcctcaccgcccatctcaccagtacctgctgttcttttctggtctcattggtcacatttaggcggatggatttttcaaattcaaaatgttccctgttcatatcaggcttctgagtcagccacccctcctcctggcaggataccatgacaggagcgaaaaagcgctttgcaaaatagtgcagtgccttccagcggccggtgtagtcaatggaggcccaggaggccacaggccagcagtcatttagctgccagtaaacagcgcccatacatcttcccctgttccttctgaaatgttccaccccatagcggatcgcctccgcctgcagaagctgtgacgcgtatagcacagtctcgaaggaggatggatagcggaacgtctgctgcatgtaattcatgatcttgccgtttgcgcctgcatttctctgatgcttttccatcacataggaaaaaatattccagtcatcctggtcatccgtaaatgtcttaaccgtgctcaggcatgggaaggactggaatccgaattccgaagcataacggaagaaataatttctgtagtctgagaaaggcttattcccatgccatacatcccagtaatgcacatcgcccctgttggggtcattgggttcatcaaaggaaccgccggaggaaggacttgccggccagtaaaaggtctgtgggtcgtattccttcagcacttccggaatcaccctctcgtacataaacagataatccctcacctccgaatgctttgaaacccagtttccctctttcacaaacatttccatctcattattgccgcaccacagacccaaagaggcatggccgcggatacgttttatattgtcagccagttcttttctgatgttttcctcaaaagccggcgtcagatcatagaccgcgcaggcaaacataaagtcctgccataccataaggcccagctcgtcgcagatatcatagaaccaatcctcaggataatacccgccgccccacacgcggacagcgttgaaattagcggccctgcagtcttccaaaagctttcttgtcttttccggggttgtcctgcccagcagatgatcctcagggatatagtcagcacccatggcaaatacctgtacgccgttcacttcatgggcaaagctctccccaaattcgtccttctccacatgcatggtcatggtacgaagaccaacgcgctgtaccatttcgtcgaccacagtttccccgcacagaagctctgtcctgaccgtgtaaagaggctgctccccaagaccgtttggccaccagagacttggattttcgatacgtatctcctccggagaaccctcgaagacctttgtttctttttcggggttctccacagtgatccggtaagaacagcctgaagtctctccctggatcctcacgatctcccctgccggttcctcctttacgatccttgcgtccacctgaggtttcagcaggacatatccctcccggtgttcctgcggcagatatacgctgtcaaggcaagccttctggataccgagcagaattaccggccggaatatgcccgcgtccggcaggtgtgcgccccagtcccagccgaacatgcagtgggcctttctgatatggacaaaaccgtccatggcatcctcagaacctcttgtaggcgcctccgagaatttttccctgatgtatgccaggggggagtgcaaaagtatccgcagcaggtttccctcttcacggagaagatgccgcaccggaaactcccatatgcggtgcatattatctgttcttcctatatactcatgattcacatagatgtctgcaatggtgtccagaccttcaaagcgcagcaaaatgctgtcacatgccagaagatccggttcacaggaaaatatcgtctcatattcatagtcattttccatcagcgccagggccttgttctcattgtctttccaaaaaggatcttccatattgccgttcctcaatagatctgtatacacagttcccggaacctgtgcctgctgccggtccttctgccctgctgtgtgcatttcccaatttttatttagattctgttttatcatccagctactttcccctttttcttttttaacggttccgtacactcacggttccttaagatcacttattcttcacttccgtcgatcagaagatggctatattccgggtgctttgcaaaccagcccaccgcataagaacatgtgggaaggacttttttgccgctctcatccagatattctgctgctgcctgcataagctttcctgcaattccctgtccccgcagggactcatctacaaaggtgtgatttatattcaccgtatttttgttcactgccggaaatgtgacttctgccagtatttcaccgtcttcattgtaataggctatttttgctttttccttcgtaaattccatgatcattctcctcttcttttttttatttcataaaagccggcataaccggcttttatatttctatttttctgctgcggcaagtgcttttgttttccactttcctctcccgtagaaataccaggtgacaacagcacccagaagccaggataccagcagagagataaagatacactcactccggccatttggaagctccggtgtcctggtggcccaggaaatcccataagctagaggcacacggatcagcacagtggtaatgatggatatccacatgggcgtcatggtatcacccgcacctctcatgacaccggaaaggctctgagttaccgccatggcaatgtatcctgccgccaggatacacatcaggcgcatactcagatccacaagctcagaggtactggtaaatatgcccataagattcctgccgaacagcaggatcagggcagttatcacagcggaggtaccggcggctatcagtgtgccctgtctggcacccttttccacccggtcatagctgttagcccctacattctggcccgcgtaggtcgtcatagtggtaccaaaagaaaagtttggcatcatggcaaaaccatccacacgcataacgatcacattggctgctatgaacatttcaccaaagctgtttgtcagtgactgcacaatgaccatcgccatggaaaagatagcctgggtaagcccagagggaagtcccagacggataatattcacggcatggttctttttcattttcaaataatggagcttgaaatcaaagacatccttcatgcgggtcagcttccacatgcagaggatcgccgatactgcctgagcgatcgctgttgcaagggcaactcccggcactcccagacccagaccggctacaaaccacagatccaggataatattcagcactgttgccacaagcagatataaaagggctgatacggaatccccgagacctcttaaaataccgcttaaaatattataataagccacacctgcaataccgataaacaggatcctcagataagaattgcaccagtctataatggtatccggggtgtgcagaagctccagcataggcataatgacaaacggtgccagggccatgatgatcaccgatgcgatggcagtcagtgtaatacagcttcctatggtggccgaaagctcttccctctccttcgccccgaaatactgggaaaccataacactgcttcccacggaaataccgatgaacagaaccagcagcagattgaggatcggtcctgcgcttcccactgccgccagggcattgtcacctacatagcgccccacaatgatactgtcaaccgtgttgtagagctgctgcgcgatatttccaatgatcagcggcacagtaaaaaccacgattttttcccacggtttgccctctgtcatatccacagggccaaataatttttttagttgtcctcccataatacgtttaccttcttctgtcacatttttcataactgatgaatccttcacagttacgtacaaaaatccacaaaggatcatatatctatcctactataaaaaggcactctggtcaaaatgtattttaagcagaaatcctgttttttcttttccttacttgacaaatccccgctccatgtaataatataataagtatcctaactattagaatacttattataatcaaaaggagtcaactcttatgaaagaatcatttcactacatgttaatggtcactcaggctgtttttcataaaaaactgctgacaggactgcagggcaccggcctgaccctgggacagccaaaggttttggactatctgagggaacatgacggttccaatcagaaagccattgccgctgcctgtcacattgaacccgcatccctcacttctgttcttggaggcatggaacaaaagggacttattgaacggaaaagcctgaacggcaaccgccgctcccttcacgtattcctcacccaaaaggggaaggaaatggtgcagtatgtggagagggaattttcccaactagaagcgcaggccttctccgaactgactgttgaggagagggatgcctttcttacagccttccacaaaatatttgaaactataactgcttacgaaaggacaaatgaaacatggaaaaactaaagtcttatctcatctttactgccggtctctttttctgctccatgggagtgagctttgtgacaaaagcggatcttggcacctccccgatctcttccatcccctatgtactgagcctgagattcccatggactctgggagaattcaccattgtattcagtctgcttttgatcgggctgcagattctcatactgcggaaaaacttcaaaccggaagacatacttcagataccggtatccatcctcttcggatatttcatagatcttaccatgctcctcttaaaaggcctggcaccctccggttatcccgctaagataacagctcttctgaccggctgtgtaatactggccttcggtgtgtatctggaggttcttgccaatgtggtcatgcttcccggtgaatcctttgtcagagcggtgtcggtgacctggcataaagatttcgggaactgcaagatcgctttcgacgctgccatgacatttaccgctgctgccatctccctattttcctttcacacgctgaaaggcgtcggtgagggaaccatcctcgcggcatttctggtgggctttctagcacggctgataggcagactgtttgacagattgtctgacacgctgaccggtgccctgtctgactgacggatattcagtatatctctgcataaaaaagcaagaggtggaaacggcttttctattccgtttacacctcttgttttatttatatcacaacaatgattccgccgtcattggcatacatgctgctcacgcctgcggtatccagaaggactacgtctttcaccggaatccgttttataatggcgtcttttactatctcggcccgttcccggcagttacagtgtgatatgcccagtattctgtccgcgctgttctctgagcgctccacaatataatccaccattttcataagtgccttattaatgcctcttgcctggtcaagctgtatgatggtaccttccggggtagctcccatgacaggctttattttcagggctgtggccacaaatgccttcagattgcttaaacgtccgttctttctaagcgtctcaaggctttccagtacaaaataggtattctggctttcaatataggcctctacctcctggacaatatcctcaaattccatattcctgttctcgcactcctcgatcttcagggcgatcagtgtctcgcccacagaagcggaacgggaattgaagatgtggatcttcttctcaggacagttctccaacagcaggttcctgcccagtacggcgctgttgtaggaaccgctcagttctgaggaaagtgtcactgcatacacatggtcagcctcacagtcataggcctccatatatctctccggggagggacatgaggattttggacagttcggtgattctgctactctttttaagaaatatgcctgatcaaagctctcatcatccacaatatcttcttcgtcgacagtaagtgtcagggatgcccgttcaatggacgggtcttctttccaacgttcaattaattctccgcagctgtctattactattttatatctcatcttgcaacctcttatatgtagtttttaatactatgttttatgataacacaaaaccatgctgttgaaaaggcttttttcatgaaagtgctttgatttttcccgtttttcgtatatactattccttagactacaacaggaagaggaaataatatcatgatagctttacaggtacaggatgtaaaagaatttatgtcccgtctgcttataggaaccgacttcgatgcattctggctgtgtgaagccagtgtgactaccttcgtcacctacaatatcgacggttccctccataaggagttctttgattccgaacaggcggaaatgctcactcagacagagcgcaccttctcatcgtggaaggagatcaaacccttctgcttctccatcatgaaaggaaaacacaccccgcttcactttaagatcatattccagctctccagacagaatgtggaaaagctgcttgtgggaagcggactttcctggaaaccggcagatgtcttcggcctgtatctgaacctgcagtacgatggaagtcatgtgacctgcacaacaggtacatcccttaaaaccttcaccatggataagtccctggaccgggtgtgggatgaaatggtaactaaatttttcaggcagcagcagatccctgtactgcttgtctgatcatatattgataatagtttatgtgaaagaaggaaaagtatgcaaaattatgaaacaaatgtattaaaacaagagtggatggagaatctggacctgtttacccgtgaaatggattatccccgggaagctgctgtatctctcagccagtccctggaacaggtttttaaaagtccggaggcgctctccatactcacagacgctgatctgacgtacagtaataatatccttatggactataaaaaaatcttaaatgaactgaaagatgtctcaccaagctgtggtgtccacacctatacactccacatgctctttttcattatcctgtcacgcaaaaccaggaaaatttatgaagagcgcggtattgcaccggaaatcttccgcgcttccatgatggatctgcactggaagcttctggaatgcaaaaaaatgttcggcatatggggtaccagcgtggctgactggcagatatggtggtttgaggtcaaacgctttgccctgggacgcttccaatacgagctggtgccttttgaagacacctatgaaaagaacggcatctctctgcacccgggcgaccttgtgatcaatgtacacattccgtcctgcgggccgctgagaagagaggagtacatgcagtcctatgccatggccgcagactttttccgggattcctttgaagaccgacccgttgtatttttctgtgaatcctggatgctgttccccgaacacaggcttttccttcccaaaacttccaatatactgggctttatgcaggattatgacatttataaagaggagtataacaacggagatctgtggagaatcttttatgaggatcataaaaaaccggccgaggaactgccccaggacacgggacttcagagagcttaccgttcctggctgatggaaggacatcaggccggtctcggattcggcgtttttatttatgataaaagattaacaggagaaaaattatgattcaggatattgcaccacatatttaccacaacgaatatctgccccatgaaccccaaaaggacagtgtgctgctctgctataaaaaagaccagatttttatgaaaaatgcggacggggaaatctcctttcccacctattccgaagcggaatctgtattcccggcagtaaaagacctctggacttatctctttaccatagatgaaactgcctattacctggtatcccagcttccttttgaggagttgccggactattcccttgaaaagacggacagccttcgcacattaagcccccgtcatcttatctttgctgggatcacgggacatcagctctataaatggtatcaaggccgcagattctgcggctgctgcggcagaaggatgaaaccggacaaaaaagaacgcatgatgtactgccctaactgtcacataatggaatacccaaagctctcccctgcagtcattgtggctgtaagaaacggggaaaagctgcttctgtccaaatacgcgggacgtgaattcaccaactatgccctgatcgcagggtttgcggagatcggagaacccattgaggacactgtgagacgtgaagtcatggaggaggttggcctcaaggtaaagaatctccgcttttataaaagccagccctggtccttcacagacactctgctcttcggctttttctgtgacttagacggggatgacaccatctgcctggatgaggaagaactgtctctggcagtgtggatggaacgctcccaaatacctgtggatgaatatgagatcagccttaccagggaaatgatgacgctattcaaaaacggactggataacaatttctgatctgccaaatgacaatatagttacaaatgtcactgtaatgtcattttgccctgctatactgtgtttccataaggaggatacacaactatggaaatactttcatgtaaaaatcttacgaaaatttacggcacaggcccaaacgcggtcacagccctggatcatgtcactctctccgtggaaagcggagaattcacagccattgtcggcgcctccggttccggtaaatccacgcttctgcatcttttgggaggtgtggaccggcccaccgagggcgagatccgtattgaggacaccgatatatccactctggatgaagaggcgcttgctgccttcagaaggcggaaggttggtcttatctatcagttttataatctgatccccacactcaccatcaagaaaaacatattgctgcctgtccttctggacggacgcagacctgacctgaaaaggtttgaccagatcgtcacaactcttgggcttactgaccggctggaacatctccccggagaactgtcaggagggcagcagcagcgggccgccattgccagaagtctgatcagccgtcctgccattttactggcagatgaacccacaggcaatctggaccggaaaaattcccaggagaccctggatctgctgaagctgtcacaccgccgcttcggacagacagttcttctgatcacacacgacgaaaaattggcactggaggctgaccgtatcctgaccatggaggacggcagggtgatcaaagaccaggtgaaccagtcatgaagatcctgagagaatataccctggattttatccggcgcaacaaacgcacaagctgtgccatcatgatagccctctatctggccagcaccttcctctccgccctctgcggatttatcaataccatgtggaaggataccatcacactcacggtattcaaatcaggagactggcacggagaattgttcggtgaggccttcggccgggatctgccccttataaaggggtattccactgtggacgatgtcctgataaaaggtaattttatcacggctgatatagaggaccccagaagagaatatctgtccctgcgctgtgccaatgccgcatactggaaacacatgccggaaaaaaatgagctgacagacggacgcatacctgaagcctccaatgaaatcgccatatcaaaacaatattttgaaaaccatccggagcttaaaataggcgacaccataactctacccatgggagaacgggtaaaagacggaaccatcctggaggccactgaaccgcttcgcagcggggaaaccttttccaaaagagaggaacgcacctttaccatagtaggtatcctggacgctgccacgccctccactgtcccctcctattacgcgatgggctatatggaagatgatgatatcaggccggaggaatccatcacggtctatctgcggttccggtctatgcgtaacacttatgaggatctgcccaaaatagcagctctgatcggctgggaaaaggatgaatacggtgaatataatttaaaatacaatgcagatcttctgtcccagcattttgtctttcccaaagaacagttccatatggacaatgcactggaggcgctggcatttcctattatgtttctgttcctggctgtattggttgtagggctttttgtcctgatcatccataacgcattctctctgtctgccaattcacgtgttacgcagttgggcatcctggcaagcatcggcgcctctccccgccagatccggcagtcggtgatctgggaaggcctgtttctcatgcttcttcccctgccggcaggacttgccacagggtggtttctggatcattggctgatacagtatgtgaactccatcaatgacgcagccagaagcggcaatataccgaaagtcactttttcgtacggactgcccagtatcctgcctgccatcctgctgaccttttttaccgtatggttctcagccaggatcccagccaaaaaaatagcccggcttacgcccattgaagccatccgccggggtgaagccggaaatattaaaaagacccgctcccggcacatcctctcccgattcttcgggatcgagggggaattggcttccagtgcgctttctgccagaaagaaatcctatcggacagctaccatctccctgaccctatcctttctggttctggcttgtttctggcatctgaatgccttccggacagtccaggcagagttctccgcaaaggaggatcaggatcaggcggacattgagtatttcctggataacggtcaagcgccggaacccgcgatcctgaaagacctgaaaagctttcctcatgtaaaggaagcggtattttattccaacttaaaatctgccctttggatcacaccggatatggtatcagatgagcttaagaacgcgggaggaatggacgctgtggtggatgcaggaaaatattatcccattaaaagagacggagaataccgggtgcagaactatttcattggcctggatgatgaatccttcaccgcatactgcgatactctaggcattgaccctgctccatattttgatactgcagatatacagtctattgtctgcaacagcattgccgataaagtgaatgccacgtccaccaggacggatatgatagactttctgaagatgcaagagggagacatccttacttatacggataaaattttggatgaagaggaaggggagtcagttattcaggtaaaagccggctacattacagacaaaactccgctccccggcgtagagtttcccggatatacactggttcagtttgtacctatgagtaccctggattccatggctgaaaatgtcagggaaaaacggcgtctgggggcctaccatgccattggtcttttcaaagccgaccacaggaaatacatttcccaggtcagggatgacctggaaaaattcagtgacagatattacggttccggtgattatatcatttccgatatcctggagaaagaaaagctgaacaatgacgccaacaaaatgtacagtgcgatcatcttctttatctcaggactgatggcggtcatcggtctctccaatgtatgggcaaccatatccggaaccctgaaaagccgcagaagggaactatccaccctgcgttccgtgggcctctctcccagagcgctgtcacgcatcttatccctggaagcactgctgttcgggctgacgccgttccttatcagccttcccgtacaagtgttgttcgtagccttcttcctgaacgcgtctggactgccctttagcgcttacctggtgcacgcgccgtttttaaagattcttgcttacactgccctgctgctggctgttatgctggcaacctatgcctccggcagcaggaaaatacgaaaagaaaatattattgactcgctgaaagacgataccatttagggcggagtgtatggatcatggaatcgattttaagatatgcccgatatgctccggtccgcataaaacctagcagtaaaacaggctcccccatttgcagcgttctctgcccgcagggtgccgttctgccgctcaaccagtgcttttgacagagccagaccaataccaatgctgtccttgcaggcattattcccccggtaaaaccgctggaataagaggggcaggtcctccctatcaaatccggggccgttatctgccaccaggatctccgtataaaggggattctggtggtattttattgtgatcctcccgccatttcctgcatgttcgctgcagttttttatcaggttggaaaaaatctcagccgtccaatgcctgtcaccgcagaaaatgcattccggctgcatctgcagatccagggtctgatttctttcttttatctgaggttccagaggctctgaggcctggatcatcacagaggccgcatccagactttcctgttccaattccagtgttcccgcgtcaagcctggacagtgtcagaagaccggcaaccaggtattccatacgggaaatctgacgctccagacgctccagataagctcttgtctcccggtttacctcctcctcccggatcagttgtaccatcagggacatggaggtaatgggtgtctttagctgatgcgcaatatctgcaagattatccgccagattctgccgttcccggcatgcctcctcctttgtcctgcgaagctccctgacggtcttatagatctcatcctccagtatggaaaatgaatcctccctgcgtgccagcactgtctctcgtccctggttcacatcctcctgatacgcagtcagttcttccatacgccgcgccctcccccgctctgcctttgtataccaaaacagccagataaggaatatcactgcaagccccgcacaggatatgcccatataggcgggcagaagaccgcttctgtaatatccgtccgtgtatccgtacctatccagccactcttttccctccccggaaacctctgcactccggctttctttcaaaatcttggccaccttttctgtaagttccggttcctcctccatggtgtaggagatcatatactccgcgttcgctctctgggtgtgggcggaaatcacggaaaatccaaaacccagaacagctcccagaaaaagggccgctgcaagtgcccccagtatggtgatcctccttgctctcttatccattctcagctatctcctccatccgataaccaatccccctaagcgtccggatctgctccggattccccagcttttccctgaggcgtttcatagtaactgtcagggtattgtcattgacaaaatttccatccgcatcccacagaagctcaagaaggcggttcctggttatggcctggttcttattctccagaagcacccgaagcagccgcagttccccggctgtcaataccacctcctcagacccgagatatgctttcatcttctctgtgtccatggaaatatggccgcatgcaagccttcccatctccgcagtcctgctgctccttcttagaacagcacggatcctggaggaaagaaccgacaaaagaaacggcttcacaatataatcatctgctcccatgtccagccctctcacaatatccttctcctcatcccgcacagtgagaaatataacgggaagtgtctcatcaaaggcctttacctgccgacagaaggaaaagccattcccatccggcagattcagatccagaagcacaaggtctgtcttttcatccaggcagtatcccgcctcctttaaggttcggcaccagacagtggtgctcccctcttttttcattgcgctttggattccaaaggcaatggtctcatcatcctccagcagtaaaatacgcggcataacatttctccctcaaaaataaaataattcctcgaatttcttgtccagtgcaatacataagatcagtgccagttttgctgttggattaaactgccccgtctcaatggagcttatggtatttctggatacccccaccatctcagccaactggttctgggacaattttttctcacttctggcttccttcaggcggttttttaaaattaattcatcgtccatctgctgcccgcctaaaaaatctcactgatatagccgacaaacagcagcacggcagccagcactgacaggattcccagccctatctcgaacttcttgtgaagcttccccccgttatacagataatggattcccatgctcacaaaaaatatgcagtacacatcgctccagggctgccctgccacaattttaacgatcatcagcgccaaagttaccaagagaatccccatcagcacaaaactgaatcctttctgcgaaacctgcgtttcccattcatccatggagcctttctttttcttcctggctagctccaaaacttcctttttttccataacggcaccttcctctctttgccaagttttcttatcatctatattatatcatgccaagttttcttgtcaacactttctgccaagttttctttgcagtccagaagaacaatctcctctttgcgggtgctgcaaatttcataaatgcaggtatcataaatacaaaatagtgcagttgtaaaaaatcattttcacaactgcactatgatcgttcttatttatttcgcactctttttatcttattttgcaagcatcatcatgatatcattgctgcgtgtcacaaattttgtcatttcctccggtgtgagctgtctgtggctcagcacagccagatcataaagctgctcacagatcacatttgtgttctctgtatcaccgttctccaggacatactgtaccagcttattgttggcattgagtatcagtgtctcctgtccgccgaacatggacgggtccataccgtacatattatacattttcatcatttcctgcatacggcggctttcctctgaaacggtcatcatggaagaaacattttcatttttcagtttttccactttaacggtcaggttttctttgttcagcacctttttaaacagttctgaaagggtctttgtctcctcttccagcgctgccgcatcatcctcttttacggagtcattgatatccgcatcaatgcgcaggaaccttacattttccttgatctgctctacatgggagataaacggggagtcaatgttgtgtttcaggatgacggcatccagaccctgttctttgaacatattgatatactggctctgctgtacttcatctgtcacatagtaaatatttgtcttctcaggctctttctcttcctcgtctttcttgctgtcctctgcagtctcctcttttgtttcctcaactacagtttcctcagtctctttggcctcttccggtttttcattggctttgatgcagtcttccagagtcagatacttgccgtcaatattcttatacaggatgtaatccatcattctctctgagaattttgtatcctttaaacagccgaatttaatgaacgggctgatatcatcccaatatttttcataggtttcacggtcggtcttgcacatgccggacagcttgtcagccacttttttgctgatatactcagaaattttctttacaaatccgtcattctgcagcgcacttctggatacgttcagaggcagatccgggcagtcaatgacaccttttaacagcatcaaaaactcagggatcacttctttgatattgtctgcgatgaacacctggttgttgtacagcttgatggttccctcaatggattcgtattccatgttgatcttcgggaagtacaggatacctttcaggttgaacggataatccatgttcagatggatccagaacagaggctccttgtaatccataaatacttttctgtagaaatctttgtattcctcgtctgtacagtcgttgggatgttttgtccacagcggatgggtgtcacttaaagataccggacgtttattgatctttactttatcctgggcaggagaaacctcaacgatttccttctcgccgttttcgttctccttctcctctgtcttggcctcctcgtggatgtgctctactaccacatcatcctctcttaaatcagcctcatcaatggtctcatactcctgctctgcattggcctttgacaggaatatttctaccggcatgaaggagcagtatttttcaatgatctctcttgcacggtattcgttggcaaattccagtgcatcctcatttaagaacagggtgatctctgtacctacttctgtgcggcttccctctccgatttcgtactctgtgccgccgtcacattcccagtgtacgggaacagcgtcctctttgtaggaaagtgtatcaatatgaacttcatcggctaccataaatgcagaatagaatccaagaccgaaatgtccgatgatctggtcctgatctgtcttatccttatatttctctaaaaattctgtggctcctgagaacgcgatctgtgtgatgtattcttcgacttcctcagccgtcataccaaggccggtatcgatgaatttcagtgtcttctcttccggattcacgatcacctggatcttgttcttgtgtccttccgggaatgtatactcacccataacctccagttttttcagtttggtaatggcatcacatccattggaaatcatctcacggaagaaaatgtcatggtcagagtacaaccatttcttgatgatcgggaaaatattgtcgctattgattgataaattaccacgcttgttagccatgatatgcatctcctttgtcttttctctgttttcttatttttattacggaaaactttactccggtttcccgctgctaaaaataatattaatacccggcggaggaaaagtcaagagaaaattagcactcattttcggtgagtgctaacaaatttttattaaaattataaacaaactataaaatcagttatgtatcatccctgtcatcaatcttctgcgccacgataaaaatattcggcggatttttgtgaagatttacgatttccagtaccagaaatccttttttctggatcttccgcatcaggccgatgggtgtatcaaaagccacatagggcatgaggtgcagcttgctcttcacaaactttttcacggagtcccttgaaaaattccttcccagacagtccgtagcggagataaacactcctccgggtttgagaagagaccatattttttccaacacctgatcccggtctgacagatataaaagcacgttaaaagctgttaccacgtcaaagctctccggttcaccgctgaaattcatcagatctgtatgacagaatgtgatgttccggcatccttccccggctgccttctgcactgctttttccatcatctcctctgatgtgtcaatagccacgatctcccttacattctgtgagatgggaatagtggtattgcctgtaccgcacccgaaatccaggacttttgcctcctggttcaggtacggcagtgtacgcttcactgtctttttatacgcttttttatagaccttccacacctgatcatcgtaaactctggatctcctgttccagaaatattcattgtctgatggtttctttgacatcttatgtttcccctttctgaacttactgtaagccgcttccgctgtctgaaatattataaaaatctgcggagcagccactcttttccctctgtataaggctgataacggataggcaggtctatcatatctgacttcctcaccacgctttttttgtgactgaaggtttcaaagctttctctcccgtgatagctccccatgccgctgccgcccacaccgccgaagcccatatgcggggtagccagatgaatgatggtgtcattgacgcagccgcctccaaaggagagatttctgagaacctttctctccgtcctcttatcccttgtaaaaagatacagggccaacggcttttccctctctttcacaaatcccaccgcttctgctgtctctttaaaggtcagcaccggaagcaccggtccgaagatctcctcctgcataacaggcgatttttccgtgatcccggtcagcactgtgggcgcgatctgaagacgtttttcatctccgtacccgccgatctcaatctgcccctctctgagcagttccatcaccctgcggtaatgcttctcattgatcatccggggatagtccggatttttcaaaggtgcctctccgaacatctgccggatataatgctttacatataccaggaattcctctttgacagattcctgcacaagcagataatcaggtgccacacaggtctgcccgctgttcagatatttgccgaacacaagcctttttgcagccatctttaaattggcggtactgtccacaatacagggactcttgccgcccagttccagagtcacgggtgtcagataacgggccgccttctccatgaccagcctgcccaccgtcacacccccggtaaaaaagatatagtcaaaccgctgctctaaaagctcctggttctctgcccgtccgccttccactacggccacaaactccggtggaaatgcctgacggatgatcttagcgatcacggctgatacatgttccgaatatgcagagggcttcaggatacagcagttcccggctgctatggccccgatcagcgggtcaagacagagcataaagggatagttccagggtgccatcaccaggaccactccgtaaggctcatgtgtcacgaaactttttgcgggaaactgcgcgagaggtgttggtactgtcttatccttcatccatgttttcagatgtcttttcacaaaagacaactcactcaaaaccatccccacctctgtcatataagactcaaatgaagatttatggagatcctgatacaaagcatggcggatctctccctcattcttttttatagccttttccaggcggtcaagggcctgaattctgaatgcccgggacatcgtacagccttttccgaaaaatcttctctgacgccggaccagtttttctatttccatattcattcctcttttccgaacttttccctattgtaatacatttttccaaaaaggacaaggcatgccagagtgtgtttgaaaaatgccttccgtgagatgtgcgggaatgatttttcaaacaagctctatctcaaacagaagaggaggaagcggggtcatgaaaaaagcaaaaagccgaaaaagtcatgattctcatcatccctttttcggcttttcaaaaactatacggatttctccgccgctatggccggctttcaattccaagaacccgtgccggtgttcccatccatcagccttctacgatcagatactgcccgttcggcagcggaaacacctcacttgcctcctcaatctcatccagggacataccgtctacatccattccgttttcctcaaaatagtccctgacttcctcgatggaatcaaccaccactgccatgcagtcttccaggaaggcctcagcctcctccacagtctccgccaccggctcggcaaaaagctgcccctgtttctgtaaaaatgtgagtaagcattcatcactgaattcgttcattctgcatatcctcctttaataatgattttatttaaaacggtttccacccgttttgtttctgctctgcacgcatttttcaccgcttcctttgcatcgcctgccgcatagctgtactttaccctggacagcatctccaggtcattataattgtcaccaaaggctgcgcattcctccggttttatattcaggctctgctgcagtatacccatggcgtttcccttatccgcgccttttggcatcatgtccagccaggcgaatccggaggtgacaaccgtagcccgctccccgaatttttctttccagtaagggtaaatgctctccacaccggcctcctcatacactgatatcttcaggtatggttcctctatacggaaaatgtcgtccataagagtcacatcattttttacaaaattggcgatatggtcataaaaggacggctgctttggctggatgtaacatgtgctctcaccggagaccagagcctccgcgctatctttttccagtatgctctccagtatctcatctcctaatgtcctgtcaaacacatctttatgtaggactctgccctgatataccacaagtgcgccattttcacaaatataagcaatatcatccttcacaggctcaaacagtctccgcagattgggatactgcctgccgctggccgctgcaaataaaatgcccatttgggataatttttttatcatctcaaccgcttcaactgaaatttcccttgtaccctgcagaagcgttccgtctagatcactggcgatcagtttcagcatggtttctctcctttgcaaacgccagtacctcatccggtctgtccactattttttttgcctggtgctccacaagttcttctcttgggcggaatccccatgtaacgccgatggtaaacatacctgccgcttttccggtctccatatctgtgttggtgtcgccaagatacaggcattcttccggggtcactttaagccggcgggcaatggcaagcgctcccaccggggaaggctttcttggaacctctgcagtctgtccctgtacctcgtcgaacagcccttcaccaaatatctgcctcacaacgtccactgctgcgtggtgtggtttgttggagaatacggcgatccgtattccctcctccttcaggcctttcagcatctccactataccgtcaaagggttttacatgataaaacgggtcctcctcaaaccattttcggtacagcacttttgcctcctcataatccaccttttccgtgccgccggaggcttttaaaatccgttttaccagctcatccgctccgtctcctgcaaaataattatactcccggatcggctgttcgggaagtccataatggcttagaagcctgttccccacaacaccgatggattccactgtgtccgcgatcgttccgtccaaatcaaatatacatgcccgaatcatgaatgccactcctttatgtctattcctaactgttttaattcctggtagagccttgccaggggaagacctaccacattgttgtaatcaccgtctatcttctccacaaacactgcggatctgccctgtatcccataggcacccgccttatccataggctcttttgtcttcacataggcgtcgatctcctcctccgacatgggataaaaaaccacctctgtcttctcatagaagctcttctgtatcttggcgccgtcctgccgtatgaaaagggtgacgcctgtgtatacctgatgtctcctgccctggagccgtctcagcatgtcccgggccatggattcatccgccggttttccgagaatagaatcctgaaatgccaccaccgtgtcagcaccgatcaccagtacatcccctgatgtcttctcaaacacttcctgacctttacagcgggacaagtcctgaactacctcctgcggaagactggatgtcataacttcctttgcactgcttggacatacttcaaaaactacccctatctgatccagcagttccctgcgccttggagaagcactggctaatataattcttttcataaatgttcccagctttctatttatgcttttttaagtatagcctctctcactcttccatgcaatatatttttgccaaatttttcttctgtacttttcaatatctgttattattttaccagaacatattgtaacactacaacgggaaatttgagaaagccccaaggcctgctgtgatcatatcattcccatatgctgtggaactgatttttcttggaaaaccggaagatatgggatataatagacagatagaaaaccacttaacatgccaacacagaataaaaggagctttccatgaaaatactttttactgacctggacggtacactgctcaacgatgaaaaacagattcccgaagtaaattccactgccatacaaaagacacttcaaaagggaaatgctgttgtgatctgcacaggccgctcctattcctccgcgaaaaaatttgtggacaggcttggtctgaaccaggaggggtgctatgccatcctctacaacggtggcatgatctatgactgctgcagcggggaaatcctctatcaacacaccatgcctctgtcctatgtaaaacatatctttgaacaggctgccggctttggcctttactgccagacctatgaaggagatcatgttgtcaccccggaagaccggccggaagccgctcaataccactggtcatcccagatggaggtcaaggtggacccgaagcttctggatcatctcaaagaggagcctgtcaaagtcctgacctcctgtctggacgacaggaaaaaacatgaagcataccgggattttatgctcccgtgggccaagggaaaggtttccatctttttctccagcgagtattatctggaacacgttatggagggcgtgtccaaaggagctgccatccgctggctctgccggtatctggacgtacccatagaacagaccataggcgccggagacgcggaaaatgacctgaccatgctggacgccgcaggtcttgccgtgtgtatgaaaaacggcacccaagaggcaaaaagacatgcagatcacatcaccgaaagggacaacaaccagggtggtgtggctgaaatcattgaaaaattcatgtaatttaatactttataacaaaattcatgtaaaatttatgaattaggtcttccaatattctgttaaaaagtattataatggtaatactaaaaatagtcatttgaaaggaaagggattaatatgggtagttttggaaaaaacttattggggttcagtgtgatcggcgcggctgccggtgcggcttattattatttgaagaaacaaaaagaagaagatcctgatttggaagaagattttgccgactttcacgacaatgtaaaagaaaccgctgcttctgccaggaatgtggcaagcaaactgaaagaaaaagtagaaaaaacggttgaagagactgtcaataaagtaaaggaacacgcagacgacattctggatgatctggacgatgaggacatctttgaggatgatgacatggatctggatgatctggatccggatgatataaaagaggatgtcaaagagaccgcccaggaagtaaaagaggatttaaaagacgctgcaaagactgccaaagagggtgctgcggagactgcagaagacttgaaggaagcagtggaaaaaagcgtggaacaggtgtctgaggaattgaaaacaagaatggaaaatgctaaaaaagccatggaagacagcacctctgaggattcagacaaaacagaataacgagtaaacccgggacggctgtacaagccgtaacccgggttttttcatgtcttattttattcctgacccatatccagcttctccagtatctgccgtttatagcttaaaaactcatctgtcagattgaaatcactgcgtctgggacgtggttcccggatgtgtatttcctctgtgatccgtcccggcctgccagtgagcaggtaaatcctgtctgataataaaacagcctcatcaatgtcatgggtgatgaagatcgtggagagatggatctgctccatcacctgcaggtaccacttatgcatagcactctttgtcaatgtatcaagggccgaaaacggttcgtccagaagtgccagtttctgagaaaacagatacgtcctcaaaagggctgctctctggcgcatcccgcctgagagctggcccggatattttttctgtgttccctccaggccgaattcctgaaaataaggctgcaccttttccctggccgcctttttcttctcgccttttatgagaaggggaagggctacattgtcttctatcgtacgatacggaagcagcatatccttctgaagcatataacttacattgccgggaacgcctgtgatctcccggccgtccagatacacattccccgtttccggcttctccagaccggagatcacattaaaaagcgttgttttgcctccgccgctgactcctaaaaggcttaccagttcctggtcatgaagttcaatggtgatatcctccaggatcttcactccgtcaaaggatttgctcacatttgaaacctttaattctgccatgtcttaacctccgggaagctcatttattccggcagatagtcgttggagaatcctgcattttccggcagctctgcctctgacaatccattttcattcagccaggcgtaaaaagcattccatctggccggatctatatatccccactgctccacttctgctttatactggtcttttaagtattcctgactggcctttaccagcttttcatccagctccggggaggcctttaaaagaatgtccgctgccccctccgggtcctcaactgcatcttcatacccttcttttaaagcgcgcaggaatgcttttgctgtatccggctctgtctccaggaaatcattattggcgatcacaaccggtgtatagtaatcaaatacaggattgatatctttaaaagcaaagtaatcggtatcaaggcctgccacctctgtggcgatccccgcccatgcgtagaagatccagatagcatccacggagtttgatttcagtgcggagacctcatctgtgaccgtgctcgggatcagctctaccttagaaaaatccccgccgtctttttccaccacattctgcatcatagctttttcaataggtgcatcccaagtggcatatttctttccttccaggcccttcggacgatccattccctctccctttctggaaatgataccggaagtattgtgctggatcaaagccgctaccgctgtattgggcagcgcatgattccccgccactccaggtgccatactgtcctggaaggagacgccaaactgggcttttcctgatgccaccaaagcgtccgcgccgtcctcagggggctgtacgatctccacatcgaggccttctttttcaaaatagcccttttcttttgctacataaaggcctgtatgattagtattcggtgtccagtccaatacaaaagtgaccttctcaaggtctttggaactgctgtctttatctgttgtattttcagccgcagaatccttattcccgctgtcctcaccgctgccgcaggcagtcatggatgtgagtacgcaggctgccagaaacgctgccagaatcttctttttcatcctaatattgtcctctctgttctgtcttatttcgcccgctcccagggcatggattttttctgcaggatatccaccagcttcatgagtataaggctgataatggatatgagaaaaataaccgcaaacattttatcaaaagcaaacgccttttttacccgtgtcatatacacaccaagcccggaaaaaccgcccagccactcagagataactgcgcccaccacggaatatgaggcggaaatacgcagacttgcaaaaaagcggctcatggcccccggcatcttaatatagcggaatatctggagcctgcctgcgcccatgcttctcaagagattcatcatatccttatccgcggagcgaaagccttccagaagtcctatggtgatagggaaaaaagtcacgatcacgatcagaatgaccttgggcatcatctcgtatccgaaccacagcaccagaagaggcgctatggccactgtgggcactgtctgtgtaatgacgatcaacgggtagaaggccttgtaaagcttgtcatacctgtccatgaggaccgccatgacaaacccgaaggccacaccgcagaaaagacctgcggctgcctctaaaagggtcactctagaattctccataagcaggggaaattcactgataaaagccttcaccacctgtataggcgagggcagcatataacccggaaccagacctgccatggagacaaactgccagatgatcaggataacagccagggccgcggccgcccacagcttactggtggtgctttgtaacttttttctcaatggtcagtacatctccttctggcttataagataccttgatataggccgcaacagaaggcgcacctgcacgaatggcaatatgctgacactcttttacgatatccataagctcgtcatagtcaccctcaatggctgtctcaaaaggccctacataatagttcagacccgtacctttaatataatcgatcacctcatccacaatacggatcagttcctcatcattttttgcctccggcaatgtctggattgctacacttgcattcattttcttttcctccttagaaatcataatggtttactgctgttattttacgcgcagagcgctttctgcccggaagatttctgcaaaacaaaaagcccccggcaggttatacccgaacaggagctgaatatcagaataaatgcgcacccaaatgcggtgcctctcttatgctccctacgccggcattacccggatcaggttaagggtgaaaaacgattacggttttactctcagccggacttctctccagctcccctgttgtcttctcaagtgtacttcattgtaaaaaaattgtcaagattaatatctgcaccgcgaagcgtgctgctgttcacagaactgcgctttttgcagagctgtgaatggtaacggtccgcatttacacctgtgaacagccatctctccagacatccgcaagccttctcatgccttcccgcagatcttcctccggcatggttgcataccccagaagtaccgttgccggtatgggaggcgtctgaccgctgaccagaaattcagagagtccatagactctgacaccggcaccggcggctcttgccacagcttcctgttcagacagcccgttttttaggtgcaccagaagatgcacccctgcgttttccccggaataggcacacacgttccccatactgtctttcagccagcgcagaagcaggtcatgttttcctttatagagactgcgcattctgtttaaatgccgctcatagtggccgttcctcaaaaaaagctccaggattttctggtcagctctggaaacagtgacggaaaagggatcttctccgcttaaatacctctgcatcagttttttgggaagcaccatataactgattcgtatggagggcgctatggattttgagaaggttcccaggtagatgacccgctcttccttgtcaaatccctgtaaggcaggtatcggttttcctttgtagcggaattcactgtcatagtcatcctctatgatatagcgttctccccgtcctgcccatttcagaagggagaggcggcgtttcaaaggcataacggttcccataggaaactgatgggagggcatgacatataccatatccgctccggtcttttccaggtctttcacatctattccctgttcgtcccgctttacgatacatctctcaaaccccatatgtccgaaatcatgccaggcactcctgtatgtagggttctccatggcaatccttctgtttctgcccaggatggtacagagaagcatcagcagatagtcatttcccgcgcccaccaggatctgttccggttcgcagtgaacaccccttgcccggtagagatactctgacacagcctctcttagagacagttccccgcacggatcccccagggcaaagagagaatcctgtgcatctgtcagcacctgccgcgataatctgcgccaggcattgtgaggaaaactgccgggggcgatcccattcaaggcaaaatcataggaagcccctcctgcctgtataagcgccctgtgcagactatcctcagaaccctcttccggcaaagtatggttttctgtctcctgcacttcctgccttttgcccgtaccgtaataaagcccttcgatgtggcatacataatatcccttacacggtaccgattcgatatacccctccgagacaagctggtcataggccagatccaccgtgcttctgctcacggccaaattccctgcaagtgcacgggaggacggcagccgcatccctgcggccagccgtccttcctggatctcctgtttaaaatattcacatatctgttcatacaaaggaacttctgcctttgtatccagtgaaatgatcaaatcattcattattctctctctgattgatggttcacagaagatgcggcgtacgcattttctataatttaaaggagcttttcaaagatacgattctgttaaataccggttctcccggtttggaatcgtggcagtctgcacagaaaaagccgtttctcacaaactggaagctgtcataagcctgggcctcagaaagcgccggctccacataacagtctttcagcaccaccagggagttgggattcagattcagacttccgtcttccttgttatacacacctttctcttcatctacaatattctcataaaggcggcactccgctttcactgctgttttctgcgccacccagtggatggttccttttacctttcttccgtccggagagtttcctccctttgactcagggtcataggtacagtgaactactgttatattaccgttttcatctttttcaaaaccggtgcatttaacaaagtaagcattcatcaggcgcacttcattgtcaggatagaggcgtttatattttttcggaggtacctccatgaagtcctcgcgctcaatatacagctctcttccaaacggcacttttctgctgccaagttccgggttttccatgttgttggcaacgtccaggtactccatctgatcttccggataattgtcgataaccagctttagcgggtctaaaacagccatcatacgaggctttttcatcttcagatcctcacggatgcagtattccagcatggcgtaatctaccgaactgttggcctttgaaacaccgcagagatccacgaacattttgatggattctggtgtgaatccgcgccttctaagggctgcaatggacaccagacggggatcatcccatccatccacgattccgtcatctactaacttcttaatataacgctttcccgtcactacattggtcagataaagttttgcaaactcgatctgcttcggcggatgtgcatactccagttctcttactacccaatcgtacagaggacgatgatcctcaaactccagggtacagatagaatgtgtcacaccctcaatggcatcctcaatgggatgggcaaaatcatacatgggataaatacaccatttgtcacctgtgttgtgatgtgtcatgtgagccacacggtagatgaccggatctctcatgttaatgttcggggaagccatgtctatcttggcacgcaatactttgcttccgtcctcaaactctccctttttcatacgctcaaacagatccagattctcctccacacttctgtttctgtatggactctccttaccaggttccgtcagcgttcccctgtattcacggatctcatctgcggtcagatcacagacaaatgccttgccttttttgatcagcttaacagccgcctcatacatctggtcaaaataatcggaggcaaaataaagacggtcttcccagtctgctcccagccatttgatatccgctttgatagattccacaaactctactttttcttttgtagggttggtatcgtcaaaacgcatgttgaattttccatgatatttctgtgccaggccatagttgagcaggatagattttgcatggccgatatgcagatatccgttgggttccggcgggaaacgggtacagatctcctggtatttcccttcatctaaatccttgtcgataatctgttcaataaagtttttagaaacggtttcttttgctgtttccttttccacttacagttcctccatcatctatatttatggtgattttttgtctaagaaatatactaccataaaaatggtaattttcaaaggctttctgtcaaaaaatttggaaaggccggtgcccggccttttctacaggtgattcctgtctgaaaaggccacagcaccggccttatattacgggatcatatatccgtaatcgctgataacggcgtccatgatctttctgagtcctgccggaactgcgggattttcatcttccagaaggatttccacaggctccccaaagagacggacttttacgcgcttctcttctctgtccagaactacgaaaccattgttttcactgtcacccatatcggtctcatccgcaaacagggtaaacttatccttatacggagcgctggaataaggacagaaggtcttacagttgccgcactcgttacacatgtaatccacatggacgatctggcgcatagccatacccggcaccttcacagcaatgttagctctgttcggacatacatctgtacagttttcacagactgccgcacaattcagacacctgccgctttcttttgccggttccttttcactgtccagtatgccctttttgctgtaacaggactcctcacagccgtcctttttcatgtctgagacaacatctttcccaaggaacgctgctgccgctttctgggcatcccggattccctccactacagttgcagggccgcccagaccgtcaccgatcacatagacaccgcttaccgcttccagtgtctggctgtctgccacaaccttgcctctgttgtcaagaggaagtccgtttgcctgataaagcgctgtatccacacgctctccaacggctgcgatcacggtatctgcaggtacagtctccatctcaccggtctcctccacagacgctcttcccgaagcatccatggcacccagtttcatcttcctgcacagcagttttccgtcttccatggaaacaggggagagcagttcccggaactcaatgccttcctcctgtaccaatgtcagttcctctgcatctgcaggcatatagcgttttgttcttctgtacaccagatacacatgctccacgccctttgtgcgttttgcggctctggctgtatccatggctgtgttgcctccgccgataactaccacatgttttccaagctctacatttccgtcctttgccttgaactctttcaggaattcagcggcgtccacaggctctcctttttccagcttcaatacaccgggcatgccggctccggctgcgaaaaatacagcatcaaagccctggtctttcagctcttttgcggagcttatttctcttcccagttccacttttacacccatttttcggatgatggcagcgtctttttctatggcttcttttgtgatcctgaaatcagggatcacatgtgccacaactccgccaagagcgttttctttttcaaaaacagtgacatccgcaccgcctcttgcaaggaagtaagctgctgccataccggagggaccgccgccgatgactgccgctttcctgccgtctgtcttttcgggaacagccagtttttccataactgcatcgtatgctttttgggctgcctccagcttcacatttctgatatgtaccggctcctcatagaaattcctggtacatttgctcatacagttgtgggcacagatggttcctgtgataaaaggaagcggattcttgtcaaggatcacctcaagtgcctcctcatactttccggcagaagccagttccatataattgctcacatcctgatggatcggacatcccgcctcacagggagccataaaacagtccataaggggaacgctgtcttttaccttgcggtttggaaggggctttatgggttttacatggtgcacgtcaccttttgcgtcctccgcaagttttgtgactgcttccacatcaattcctgtaaaaggcttcaggccttcttttaccagaagttcagccatctgcgcactgcggttgtatccgcccggttttaaaagagtggtagccactgtcacaggccagatgccggctcccacgatccgggatatattataataatctgcgccgccggaataggcgatccgcaggcgtccgtcaaactctttggcaagctttgcagccagggaaatggacagagggaacagtgccttgccggacatgtacatctcctcgcttggcagctcctgtctggtcacatccaccgggaaggtattggttatcttcaccccaaaggacagccccagctcttcggacagcttcataagtcttgtaaacatgggaaccgcatcttcatactggagatcatccttaaagtggaaatccccgaacatcatgtagtcatatcccatttcatccatggtctttctggcaaattcatatcccagaagggttggattacattttacaaaggtattgatatgcttctctgtgaggagatagttggctatactctcgatctcatgaggcggacatccgtgaagcgtggagatcgtggcagaattacagatatcttccggtatggcctccacatcctccttcgtatatttatcaaatttctcaatatttttaagcagccattttttacattccgtaaatgtggcatcctgtcccgcgtgcatcatcgtgtcaataaaatgattgatcttctctgatttgatacctgccaggtcatatcccacgctgatgttgaactggaatccatcctgtgcacccagtccgaattcttttgccatcacatgcagggcaaaccatgccttgatgtattcactcatagcatccggtactgtcagctctgtggaccattcacagttatacccttcatcctcagctagaatacacggcttattcacacaggcggaaagctccgcgccatccatgatctgtactgtcttcagctcaaaaaaacggcttcctgtataatacgacgcaatgatattctgagcaagctgcgtatggggtccggctgccggacctatgggagtttctagatttcttccgaagatctccgttttctcctctcccgccacatactttttatgtgttccgaacaccgttttatttgcttttttctcttccagaacccagtccatgatctgggaaaacggcatacatgtcatcttatcgcccataataaaaacctcccataaatcccttatcttccattaatagaatctgctaatttttttgcttcttccctgcattttgccataacttctgcttcgtctgccactaaaacttccctgtctttcataagaatttttccgttgcagatggtggtattcacctgtcttccggtcatgccgaacagtacatggctgttgatattccctgcatgcataggggtgagcggatcataatccataacgatcacatctgctgccgctccctctctcagtacccccaggtccttcttaaaataacggcccgcgatctttgcattgccctcaaaaagcatttgaggaatttctccccacgctgcattagggtcacagagatggtgtttatgaagaacattggccactttgtaggattccagcatatcatgagtatatccgtctgtgccgagtccagtcaggattcccttctccacgattttcatggttggcgggcatccgcaggcatttcccatgttggattccgggttatgtactaccatggtatctgtctctttcaaaagatccatctcatgctcattgatataaatgcagtgtccgagaagtgtcttctctcccagaatgccgcagtccatcaaacggtccacgatcctctttccatagtgtttcagacagtgatgcagatcctcgattccctctgccacatgaatgtgatagccgatcccatccggcttatgtgctgcagccagctccatggtctcattggagatggtaaaggacgcgtgcattcccatcatacctgcgatcatatcactgtcatccgccagggcatagcgtgcaaaccgctcattttccattacagattcacgggccttctccatcccgtctctgtcagagatctcatagcagaggcaggtgcggatccccaggtcttttgccgcttcactgatggtgaaaaggctgtcggatatgcggcagaagctggcatggtgatcgaacaccgttgtcacaccgtttttaatactgtcaagatatgtggcataggcactgtattttgtcccttccagtgtcagatgccggtcaatggtccaccacataccgtccagaatatccagaaatccgtgaggatcgtagccgtctatggacaaacctcttgcaaacgcactgtaaatatgctcatgtgcattgataaatgccggcatgatcacaccgccctttgcatccacatactccgcatccggaaattcttttttaagttctgcttcatccccagccttttttaccacatttccgtccagaactactgccccgtgttcaaaaaaaggtttctgctcatctcttgtcaccagtcttccgttcccaatcattaacatagttttacctccttgcaaactccatacttgataagtatactgcacttcccatatttattaactctagtttatcattacattgaagtaatagcaagtgtttttctaaaaatttttgaggtatcacaaatttttttgtattccattctgcagccctgttttatacccctctgatacagcaaaaagccatcaccgatttccctatgggacttttggtgatggctttttatccgtctctttctcaatctctctgaagcataaaattgaccatggcagatgccaggagcttcccggtcttctcagagcggcattccgtatgtatattggccagatgtcttccgatcctgtctgctttggcggtcaccaaaagcgcgtcttccctgtttcccggaagcaggtaattgatgttaagattaatggttggagtcacagtacatcccgtcagattgcgcgtaagggcgccgctggtggtgtccacagccgctgctatgagtcctccgtgcatggtggacatatggttcagctcccactcctgtaccggatagcgcagtgtcagagagcgttctgcagcactgcaggaatgaaattccagacccattcggcagtagagatgctcgggatttttaggatacatgttttctatatcccgctggatctctgtttccatctttttctgtttttcatcttttatcatattcgtctcttcttcctttctgttttcgcagcatttcttccagtctctgcagggggactgcgggactgtacagatatccctgatataaactacagcccaggcgctgcaaaaggctgcggatctcttctgtctccacatattcggccatcactacaaaatccaggctcctgccgagagagataatggaagatacgatctcctgatttcgtttgttccccacaatccctctgacaaggctgccgtccagcttaacggcataaaagctgttgtgctgcaggtatttcaggctggtccgtcccatgctgaaatcatccacagccgccagaatccccgctgctttgagtctgctgatatgatgagggatctcctccattctgtccgctgcagattcctctgttatctccagacagtaatgccccgccacacggtgcacctctgccatccgtataaccttctccacaaaccggggttcattcaattgttccgccgtaatattcgcagatatcgtgacaggactcccaagttccagtagagcgctgcacgctttcatggaggtctcaatgacgcactctgtcaggcggtcaaaaaatccgtcttcctgggaaagtgccaccgccagaggcgggtaaacggcctcctccatataacgccatctcaaaagggcctctgcccctatcatttctccttcacagttaaactgaggctgatatcccatgttcagattcttctcctccacatcaatgcggagctgggccgccatatttcttgccagtatccccatgctgtcccgctgccccaaaagactcactgccgtgccggcctcctgatattctttcagatattctgtgagttcattctgcagcatctccgcctgatgctttctcacctgttcagacagctttacaaagggtgcgtagatcgcagtgcccaccagcacgatcaccacctgcacagccacccctctccaggaaccggaagccagatatccactgaaaaaaactggtgtagtccacgtcaccgttcccttcacaatgggaagaaatccgctgactgccgcgccgtacgcaagcagcaatgaacataagggtgtcaggataaagggaatgatcatgacaggatttaatacaatgggaagtccgtatacgaggatttcattgatattgaaaaagactgctggagccgctgaacgggccaactgccggttatccctgctgccggcaaacagcagcagggctgtcaccagacagatcgaagtaccgcatcctccgatcaatgcgaaattatccaaaaacgatttggatatcactgctcctgacactgcatcattcggcaccagatatgtctgggacacctgttccagggcattgccgccgtgaatcccaaaggcccacaacagatccagcacaagcacatacaacagtcctgcccccagaccatcgttgacattgtgaaagagatccacaataaaatttgtgatcagatcatttagattatccgccttaaaaacggcttttatcagcagattcaacgccacaaagatcagcgtacaaagcaatagcggataaatcgtggaaagggaattccgataatccacttccgaaccggcagaacgaaacctgaatgccggagacatcttttcacaaaaaaagtaaaagatcctggtcgccgcaactgcagtaaacatagccgaaaaaactccaaccgggccaagatcactaagttccatggaaccgccggcagcaccaaatgacactgcaaaacaaatggcagaaaccaccattgccatgacctgcaggaactgatctctgtctttcatggcggccgcgtaataatagctgatactcatcaccaggtaaatagacataaatcccaccgtggcatcaaagagaaagctcaggatctgatacagcacacctcctgcccatttttctataaacgtctgaaatgcaggcactggaaagcttctgaaaagcagcgcaaaggcccccaccagcagcgcagggatcagtagtgtaaacccctttcggatagaggaaatgacactgttattctctattctgtaaattatcttcaatacttttccatacataaaatgcccccttttgtctgccggatatagtaccgagaccaaacaaatacctgcattcattttacacgcccggcccgacttttgcaatctaaattccccggaccgaacgctttgctcctgttccaaaatataccaaaggacgccaaaacgtccgttaatattccaccctgagaagcgtgaggccctgggcaggagccgtgaatccggccgcctccctgtggcaggccaaaaggatatccgtcatctcctccggctttctgacccctctgcctacttctaccagagttcctgtgaggatccgcaccatattgtagagaaatccatccccggtgtatgtgatcctcaactccccgggcagtgattccacgtcaatgctgtaaatggtccgctccgtggattttttcatcctcttgttggagcaaaagctcttaaagtcatgagtacctgtcagcagccgggctgcctctttcatggaatccacgtcaaaggtctcatggagaggacactgatactttctctcaaatacattcttgtgataccctgccgcgatccgatactgatatatctttttcctagccagaagacggctgtggaagcgctcctgcacctggctcacttccttgatccctatatcctccggcagatagcggtttaagtattcacatatctcctcacagcttttttctgtgtccatatgcacattggccacctgccctttcgcatggacacctgcatctgttctgcctgcaccgtctatctgaaccggtgtctccagcattctggacagaacctcctcgattttaccctgaatagtattgccggtagtcttctgcctctgccagccctcatagcgtgttccgtcatactgtatatccaatctgtaattcatgttatatccctcttctcataatattccatctgatattccatcgcttctgtctattctatcagacatcccattcgacgaaaagggagaattttcaatttttctcttgacaaatccactttcacctactatagtgataaacataaaataaataattgcaacagcgaaaccgtagaataagagtagtagatatccaggttttattgataacggcagctatactgccggcagagagtcttaaattggtgggattaagataatagaacggatattgaatggacttatgaggtcgggaagaaaggaattttccaagtaatgcccgacgggatgttcacccgttatcaaggaaccgtgtatgaaagtacatgaacagagtggatgatagattcatcaagccgggtggtaccgcaaaagattgtataacaagcttttgtccctgcagagattgcagaggcagaggctttttttattgccgctgtacccctaactccatctccgggattcgcgccataagaaaggagaacaatatcatgaaaaaaattccgcacagagtatatttaaccgaggaccagatgccaaaacagtggtataacctgagggcagacatgaaaaatcttcccgacccccttttaaacccaggaacaggcagacctatcaccgaggaggaactttatcctgtattctgtgaaaagctggcacaccaggagctggacaataccacccgttaccttgatattccggaagagatccaggacttttacaaaatgtatcgtccctctcctctcatccgtgcctacaacctggaaaaacacctggacaccccggctaaaatttactataaattcgagggcaacaacacctcaggaagccataaattaaactcagcagtggctcaggcctattatgcaaaggaacagggcttaaaaggactgacaacagagaccggtgcaggccagtggggaaccgctctggcggaagcctgctctttctaccatctgcctctgatcgtttatatggtaaaatgttcctacgaacagaagcctttccgcaaatccgtgatccacacctttgacgcggaaatcattccaagtccaagcgagaccacggagatcggccgtaagatcctggctgaaaacccaggcacttcaggaagcctgggctgtgccatctccgaggctgtggaaaaagctgtttccacggacgggtacaaatacgtacttggttccgtgctgaaccaggtactgctccaccagtctattatcggtctggaatccaagacagccatggaactgctggatgaatacccggatgtggtagtgggatgcgcaggaggcggctccaatctgggcggcctgatcgcaccgtttatgcaggataaacttacaggaaaagcaaatccccgcattgtggcagtggagcctgcttcctgtccgtccctgacccgcggcaaatacgcttatgacttctgtgatacaggaaaggtgacacctcttgccagaatgtacactcttggctgtgacttcattccgtcagcaaaccacgcaggcggcctgcgctatcacggcatgtctcctatcctctccaagctgtatcacgacggcttcatggaggcaatttctgtggaacagagcaaagtattcgagacagccaccatgttcgccaaacaggagaccatccttccggcccctgaatctgcacatgccatctacggcgctgtccaggaagcactgaaatgcaaagaatccggagaggccaaaaccattctcttcggcctgaccggaaccggatattttgatatgtatgcttaccagtcttttatggacggaaccatgaaagactatatcccaacagacgcagagcttgaaaaaagctttgcgcggctgcctaaaataccaggcatccaggaataaaaacgcctgcaaaagccccgcgttacagattttcagtctgaaacgcggggctttatttaaatttttcgcctgtcaaccttccattttacagttgtcagttattacgtccatcaatttttatcgtaaggatcatgggaattacaataaaaaatacaacaaatcctccgatcactatattattatgcatcgttgaaactgcattcggaaatataaaaatccatgtaggcgctcctatgcttcggacaagccatgccacaaattctcccttagaaaaaggccccaaataggagggcggtctctctatttttttaccggaggcatatgttggatggattttaataaatactttatgaaaaacatattcaaaaactaataatatgaatattacgaataaataagatttaatatacgcaggaatcataaaactccttttctgcataggaactctcaataaaaatgtacagctttcgacctacagtatcctctttcatatatctacttctgccgtcctcacagcaggcatttcctcatcttggggcagtctttttaaaaatgccgccaccagaggcagcgagatggcaaaggtcagaacatctgccactgcctgcgcgatctgcacccctcgaagccccatcactgcaggtaatataaggatcaagggaataaagcatatcccgcttctgagggccgagagaaaggacgcctttttgctctcccccacactctggagcatcatattggtgcagacagaaagaggctggaagaagaaggcagcacactggcatcggagcgcaaagacaccgatggctatcacctccgggtcatcccggaatatgccgatgatacctgaggaaaccagaaggcagatgattgcaaagcttccgagcatcacctcgccagacccggccgtaaaccagaaccctctctttacacgggaatattttcctgctccgtagttgaaggcagccaccggctgaaatccctgaccaagcccaagccctacagaaaacaccagcatacagattctgtttacgatactcatagcagccaccgccgcgtccccgtataccgctgcctgatggttcagaagcatggtggaaacacttcccagaccctggcggatcagacttggaaatcccgtggcaatgatcaggcctatttcacggatatcacgtgtcatcagccggaaagccagtctgctctgggtctttttcgctacaaacatatagagcaggataaagaaactgatcatctgggaaagggctgttgccaggccggctcccgccactccaagatccaggccaaacataaaaataggatctcctatgatattcaggataccccctgtggtcagtccgatcatggcataagctgccattccctcatagcggagaatattattcagaacacagcttcctgtcataaaaggacctgccagcaatataaaaaatccgtattgtttggcaaaaggcaggatagtatccgtactgcccagcactctcataaacggggtcaaaaatgtgatccccgctgctcctatcacaattccagtcaaaatagaaaggaaaaaactggtggacgcaaacctgctggcactctcccggtccctttttccaagctttctggagataatgcttcccgctccgtgtccgaacataaatccaaaggcctgcagaattgccatcaggctgaaaaccactcccaccgctccgctggcgctggtccccaggcggctaacaaaataggtatccgccgtgttgtagatattggtgatgagcatacttataatagtaggaatccccaatcccacgatcagactggacaccggtgtctctgtcatcttctcatactgtttccgttcccgctcctctgctgtccgcttctctgctgtgatttctgctgctgtcatgattttctttctccccctctctcattataagccctgccaagctttccaccataaaatgaaagctggcattgctgtctgtcagttcataagtaagatatccttcccgctccagggaaacaaatccgtgcagcgcgctgcgcatcatcctctggaaatgcaccactttctcctggtcctccactaccctgccgatcagcaccagaaacggatgtatgatacgctgtatattctgacgcagctcttcattttccgaggtgcgcatctcaataacagcctgatacagctccggactgtccttggcaaaaccccggtaggccttggccatgaccaagagcgcttccgtaaaatcctgaaacccgtatgcctgctccagtgccttttccagaattgatattccgtgaaggcccactgctgtataaaccgcctctataccatttacatgattatagagagaagccggctgtactcccagacgggctgccagttcacgcatggaaaaattccggtatcccttctcctccaccagcccaatagccgcctccgcgatcacttccgtattcagtccttttcttcccattatgcctccttgtttctcagatgcaaagcaaacttactaaataaaagcaaaaactaacaccgttcgtattatctatattatatacgaacggtgttagttttgtcaattatggataaatgccgcctgagccgcatgcttcatcagaagctccatatcgctgtaagtgatgtggtaatatgcctgaagcagttccagttccccggttatggtggttttgctgactgtccggttatccgtattcacggttacgggaatgcctgcctccagaaattccagaaacggatattcttccatgtttttaaccgccctggtctggagattgctggaagggcacatttcaaggggaatctgctttgcagcgcaccaagctttcagttctttatccttactggcggcgatgccatggccaatcctgtcagcccccagctctatggcatcccacacactcctgggactgccgcattctcctgcgtggatggtaaaaggaattcccagttttctggcggtttcaaacattttggcgtgcagcttaaccggaaaagcagcctcatctcctgccaggtcaagagctgccaccccctgccccaggtattccctggcagtttctgcaagctccacattctgttccaccggcatatgccgcataccgcataggatcagatttccatccacaccgtatttctcttttccttcccaaaggccgtccagcgctccctcaatgatctgcctgcaggtaagaccgtcacgcacagataaaagaggcgcaaaccggatttccatgtataccacattttcttttgccccgtcaccaagcagttctgacacagcggtcctaaagctgtcccggtccgccaggcaggacagcggcagatcaaatttttccagatactctttcagacttctgcagtccggctccacctgtaaaagctccataagcttttctcctgccgggatctccaccccggctcctgcagctagtttccggatgactgcctcagaaagagacccatccagatgacagtgcaggtcatattttttcagttccccaatggtattcatctgcattcctccaggtagtttttggatatggaaatcgtcccctttggcataggtatgccgaaattctcagccacgcaggcgcccaccacggcaaaggaatccgccttgggaagctcctttccctccttaaaagagggggaccagatcagaaacggcacctgttccctggtgtggtctgtccctgtataggtggggtcgtttccatgatcggctgtgatgatgagcatgtcatcctccctcatagtgtgaagcaggatccccagcttctcatcaaatctcataagctctccggcatacccttccgggtctctcctgtggccccaaagggcatcaaaatccaccaggttcacaaaacaaagcccgtgaaaatcatcctctttggcctcctgaatggtctgctccataccatggacagagcttttggacttcagcgcttttgtgattccctccccggcaaaaatatcattgatcttaccaatggaaatcacatccagccctgcatccttcagagcgttcagcacagttttcccgaaaggcttaaccgcatagtcatggcggttactggtgcgcttaaattcgccactcttcctgcccacatagggtcttgcaatgactcttcccaccttccactcatctctcatggtaagttctcttgcaatttcacagcaccgatacagttcttcaaggccaaaggtttcctcattgccgcagatctggagtacagagtcggcagaggtatacacgatcatatgcccggttgctatttcctcctctcccagctcatccagaatttccgtcccgctggcgcttttattgccgatcaccttatgcccggtccgcttttcaagctccaagatcaattccggaggaaaccctgtctccgtaaaggtgataaagggcttttctgttttcagccccatcatctcccagtggcctgtcatggtatccttccccctgctgatctcattcagctttgtgtaataccccatgggatgttccacaggcgctattttctccagtgggtgaagatttgcgattcccagcttctgcagattggacagggagaagccttttacatgagaagcaatatgtcccagggtgtctgcccctgcatctccaaactcagccgcgtccactgcgccgcctacccccagggaatctatcacgatcacgaatactcttctgaatctctctttattttccatagtcattcccctctgtccctcttcccggcattttccttccgtatcaaggccctgacagcttccactgccacctggatcgcgctttctgtatcgtgcacaacaggatttggcatatcttttttggcccgttcctggttggcaaccaccaggaaaacgctgccggcccgtaccttcagataactggcaacaatgaaaagggccgcggattccatctcagaagctttgcagcccagcttcagccatgcgtcccatttgttcagcagttcataccccaccggttttgtctccggggagtgctggccgaaaaaggagtccttacactgcaccactcccacatgataaggttttttaagtgtctttgctgcacttacaagggcatttgtcacatcaaaatcaggtacagccgggaactcaatgggggcgtactccctactggtcccttccatgcggatagctccgttggcaatgacaaggtcaccgcttttcacatccagatccattcccccgcaagtgccgatccggataaaggtatccgcgcctgacatgaccagttcttccattgcaatggatgcagaaggaccgccaatgcccgtggaggttacgctgaccatctctccctccagtgttcccgtataggtcacatactctctgctgtctgcgatcagctttggatcatcaaaatattttgctatcttttcacaccgcttagggtcgcccggcatgatgacatagcgccctacatcacctcttcccacctgtgtgtgatattgttttccctctacttccgaataatttatcatatattcatccctttcctgtaatttacgtggctcatagatttattataacaaatcacagcaaataaaaaaggtcatgtgtctcttttttacaaaaacatgattttatgatacaataatgtcaggtttcactatccctgacgcctgcccggcaccgaaaacttctgcttcaactgcggacacacaccaggaggtataaacaatgacatggaatttgctcttgatctcatctgtaattctgctctgtattctgctgcaccggatttccgaaaaaataggcgtgcccatgctgctggcatttatcgtcctcggtatggctttcggcacagacggtatactgaaaatcccctttgacaattatccccttgcggaaaatatctgttccatcgccttgatctttattatgttctacggcggtttcggcaccaactggaatgaagccaggccggttgctgtcaaatctgtgctcctctccacactgggtgttgtgatcacggctgccctcacaggcttcttctgttactttgttcttaaattcagctttctggacagcatgctcatcggttctgtcatcagttccacagatgccgcctctgtcttctccattctccgttccaaaaatatgggattaaaatacggcaccgcctccatgctggaactggaaagcggaagcaatgacccctgctcctacatgctgactgcagtagtcctctccgccatgagcggcacagccagcacaggctctgtcctttctatgatatttgcccagcttttcttcgggattctttttggatgtcttatagcctttgccgcccgttttatcctgcggcacatgcagttccatattgcaggatttgatatggcttttgtcatcgcagtcgcgcttctgtcctatacgctgccctccatggcggggggaaacggatatctgagcgcctacatggtggggatcatccttggaaatactaagatcaggaataaaaaatcactggtaaacttttttgacgggatcacaggacttatgcagatgctgatcttctttctcctgggtcttttggcaacgccgtcaaagctgccctctattttcctgcctgccctggcaattgccctgttcctcacactggtggcaaggcctctggcagttgcctccatactgacgcctttcaaatgtcgcttcaaccagcaggttctcatctcctttgcaggactcagaggtgctgcctctattgttttcgccattatggcaactgtagatgacgcctatacaagttttgatgtctaccatatcgtattttgtattgtactcctgtctattttattccagggaagctttttgtcccaggctgctaaaaagcttaacatgagtgatacgaatgcagatgttatgaagactttcagtgattattctgaggaggtggacctgcagtttatcagaatccgtataacagaagaacacacctggagtcatacggcagtcaaagacatctcccttccccctgacactctgtttcttatgcttctgcggggagaggaaaccatgatacccagcggggaaactgtttttctcccgggagatacagcggtgttaagtgcccgcggctatcaggagcaggaaaatctggaactgacagagatgaaaataactgccaaaagcccctggatcggcattaagatttccgacttttccccttatccgggagaactggtcattatgatactgcgcggggaggagaccattgttccaaagggtgacactgttatcatggaaaatgatctgcttgtgatatactctataccggaataccgtaaaaacctacccgtaaaagaacttccctccgaatagaagaaataagtcctccggtcgctgcattacaaaaacagctctgcggtctatgctttttccgcagagctgttgtatattacagtaacagttcagccttccactgtcccgcgaggtgttgccttgcatttgcaaggcaatcccgaggcagccacgcgccagactgccgtttgtgcagtctgtgtacatgcttttgttgctatgaagccgaaagactgaatcgtaacatattacatgtaagatctccagtaccccacatgtctttcgttgatctctttgatgatttcaggttccaccttgaagtttctctccatgtccataagaccgttgatctcctgctgaacatctgacacctgcgtatagcagaagccgcagatataaggcacctttttcacagccgtggtgatctcatcaaaacggcggatgaactcttctttgctgttcactttattgccgtatccccaaccgctgtcgtcattgttgaaggcgatccctccatactcactgataagcacaggctggcctttgtattcgtatccgttggccatggcagatttgctgctgctgtgatacatctctgtattcaggatttcctctttgtgtcccgcgtaccggttatagaaaatatcgccgcactcctcatagtcatgaagggtaataatatcagaaaccgtatgttcccacccgtcgttgaccaccacagggcggtatccgtccatgctctttgtgagatggtaaaccgcctctgtaaaatgctgctgtcttctatccacttccactctctggattccccaggattcattaaacggggtccaggtgataatggacggatggttataattctgacgtacaatgtcaatccactcttttgtgaacaactccaccgcataatctgaaaatccgtaggcagccgcagcctcactccataccagcatgccctttacatcacaccagtataggaaacgctcatcctctatcttctgatgtttgcgcagtccattgtagccaagggcatggattttgtcgatatcctcgatcaacgcctcctcactgggcggggtcagatgagaatctttccagtatccctggtccaggatcagtctctgataaaggggtctgccgttcagcagaatattgggtccgtcaattctgatctccctcataccaaaataggagccgacttcatcctggacctctcctttataaagaacccggaaggaaatgtcatataggtccggttcctccggagaccaagttctcactccccagacaaaggcattctccccggtacccgaaacatccagcaccgttcttacatgagaggctgtcatggcagacacactttttgccacaaacataccatcaaagctgaccactgcctccacgagaagctcctcacctagacaggcggaatcccctttgatctcatattctaactccaccgcgttgtctgtaaggaccggggttatcttcacactgtccagactgatcttgggcacatattccatccagactgttttccagattcccgttgtctgcacataccagcaggcaaagttttcttttatccagcgctgttttcctctcggctgatggatgtcagtggaatcctccactttcaccaccagttcattttccccatccttcacaaactctgtcacgtcaaaggaaaaacgggagtatccgcctctgtgactccctgcgaagctgccgttcacccacacctttgtgataaaatcactgccttcaaaatgcagaagaagtctctttttgcaaagctcttccccttttgccgtgaagctgcgtctgtaccagacattttcgtggatctcctcttcgccgataccgctcaggctggtctcataagtaaagggaacctgaatctgtctattacctgcgaacttctcataccacgcctctttttctccgcagttctcgtcatcaaatccaaaatcccatgttccattcagatttacccagttgtcacgtacaaactggggtcttggatagtctttcttgtagcatttcatttctgtttgtcctccttataggtgaatgtcaattgcattttcgtcatcctttgacgcctgacatggtgattccttccacaatctggcgttcaaacaggatatagataagaataacaggcacagccgctatcatatttgctgtcataggctttacatagtccaccgtgtaggtccccgcaaaggttggaataccaatgggaagtgtgaacttgctgctgctcatggaacagagcagaggccagaggtaattattccagcttccaataaaagcgaagatgcagacagtggagataaccgcttttgacaaaggcagaaccactttaaaaaacgtggtcaattctccgcctccatcaatctgtaccgcctccaacagctcatttggaagccctttaaagaatgtcaccataatgatcagattcatggaacctgcaatggtgggcaatataaggcctgcataagaatcaataagattcaggccgtttgccgtgataaaaaggggcacgatggttgcttcccccggcaccatcagacccagaaggaaataaaaatagagtgcactgctccccttaaatttgatctttgccagggcgtatgctgccatggcagacaggatcacagtgagaactgtggtcagcacagcgataaatacgctgttaaacagccatttagtcacatcagaacccaggataaggtccggataattctggaatgtatacggcggtgtaaaccagtccagtatactgttgatctgttttccctctctctggaaggatactgcaagagaccacaggatcggtgtcataaatataactgccaggattacggatatcacggacagcacaatactgcccggctttttctttgccttagaattcatctgcctctgccccctttctctcaatcgccttctgcacaatggtcagcaccacaaggatcaaaaacaacacataggacatggcggctgcataacccatgttgtttttcttgaatgctgtctcatatatgtattggatcaaaggccttgtggagcctgcaggtccacctcctgtgatcatgtagatctgtccgaatactttgaaacaggcgatcacctgcaaaagcaccaccaggtaggtggttggtttcagaaggggcagtacgatggagaagagctgctgtctcttagcagctccatctatggacgctgcctcatatatctggggcgaaatatcctgcagcgctgacaggtataaaagcatggaaaatcccacggtccaccagatggtcatagttgtgatggccgaccaggcaaggccgctctcattgagccactgcagttccctgtccgggggcagcaccttgataaaatgcagaaatccgttgataaatcctctgtatggcgtgaacatatattttgcaataaatgccgcaaccgatacggacagcacactgggaagataataacagatgcgcagtcccttttttaatttgtttggtctgttggcaaacagtgccaggatcagcgccatgatcaccagaagaggtgtggtgatcagcacgaaatatgtggtatgccagagggcgtccagaaactttttgtctccaaggaactttatgtaattgtcaaaacccacaaacttcacttttcccatcagagaccatttatgaaggctgacgtaaatcccttggatcaccggccagatggtaaatactgtatacaggataaaaaaaggcaatataaaccccagtcctgccagcaggtttttgcgttttctttttttactcacttgatttcctccttacagcttaacgctcacaatagttttgctgtctgcaagggaaaggagagcctgtatgctcccccttctctgcctttcttatttacggaagattggtatcaagttcgtcgtaaagcatatcgactgcctcttctgcgtctgtgtcgccggaccacagagtattcaggctgtcgatcatacctgatttcatggcattaaatgtagaaacctttgaaggaagaacagcggtttccagagcctccatgtagctgcttctgtacggcatatccagatattcctgactttcccttaccgcgttgctggaaggaatctgaccagaacctgcccatgtaagaccacctttttcagaggcacttaccataaattccactgctgccttactgtcttctccgcttctgtctttcttagtcggaaggatcagagtatgggaatctgcccagcacgcgtttttatcaaacatctgcggataaggcattgcgccgaaattcaggttctctgtcttctccagtgctccggttccccatgtaccgccaatataaataccggctttcccgctctggaaaaactgctgatggtcatcaatcccctctgccacataacctttgtcatagagactttttacaaattctgctgcctttaccgcagtatctttatccatggtaacttcgctgccatcctcattgaccagaggagttcctcccatttggaaatacgatgcccaccatacacgatacgggtcatctccgttatttgtcagagaaataacagatcctccctccggaatgacagctttgatcttgtcacagaccgcgtagaaatcgtcttcactggcaatatcaagctggcccttgtcattcagcgcaacgcctgcctgctccaggatatctttgttgaagtacatgatctccgcatgagtatccaggggaactgcatagatggaaccgtcaaaggttacggattccatggaggtctctgaatacatggtacttaaatctactcccagctcatccagataatcatccagaggctcaaccacgccctgttccaccaactccggaagggaagacgcatgggagacgccaatgtcagggcctttacctgctgccactgctgtctgcagttttgtatagtaatctgcccataccagcataatggactgcacctgctttgtggggctgctctcattgtattcgcttatcatcttgtccatgaattctccgtcaccgccgctgaacagagaccaaaatacaagcttgtctttatccacagcaactgcctccggattattcaccgttccgtcgtcatttacatctgcggaggcctcttcaccctgctctggtgcttcattttcttgagaagattttaccccccccctcgcttttttctgaactttcgcttccacagccggcaagagccgctgcagttaatgtaagtgccatgatcgatgcgattgctttacgtttcatattttcttttcctccttaaaaattggtttcttaactctttttgcgaccggtcataaaaacaatattactgttggttgttggtatgtaggcttcttatttagaacagttttattgttctttatgcatccataataccgtcatttcatccatatgtcaagtttaattttgcttttttttgtgtttttgaccatttataacggtatttctgtatataaataacagtaatactgttttatttaggggatttccactgcctattttcagtatttctgttataactatagaacgtcttttttacctttggtatgatatgtcatctgcttttccttttcttttattccctgcgatatacatttatttcatagttctcctctcaaagcaatgaaaaaagcctgccaggcggaaatcccgccatattttctgaaaaacaaaaaactgccatacagaaaagctgtaacccccacagcttttctgtacgacagtttcacttaatattccacgctcatcacaatatcctgctcataattcccaaaggacttcccaaacagattaaatccgccgatatacctggcatcctctttattccctatccgcacatcaatatatggcttttccatcagcctaaggtccttcaaagctgtttccccggcctggcttccattgataaaacagccgttttccagcacctcccaggtcatgagcataccgtactgggtggagccgtccggccatacagaagggttcagtcttcccctcctgctcccaaaatcaccgggacatgtccaggttccgcagtccacgccgtttatccatacggtaatgtctgatttccagtcctccctgtatcccggtgcctcggaacagatttccatggacaggctcaggctcctggcatggcggttcctgggaaccgcattagcaaatttatattccacatagccggcagatgtccagaaaagccctgcctttattttctcaggatcgtaaaagctgtattctgtatcctccatgccgataactccctccggggaatacagtccgcaggtgggatggactttacagccagtataactgccgatgggcatttccacactgacgatctcattgacatccaggttccgcctcagcagacacatgttcacaaaatcaaattttctgctgcataccttcatggttcctctgcttccgggctgttcctccatacggatcaaatctgccttttccagaagcttcagatgaaaagcagcactggactgaggaatgtccagcgcctttgcgatctctcctatgatcatattgtcagaatagagaagcttcaatatttccacacgcacaggggaagacagcgcttttcccacatcacagagtgtatccacattttccatgtctagctctcttatttttgccataatacaccaccatctctttttcttatatatctaaacaagatacttccatagattttgttttagtataacattatccctctcttccagcaagaagctgcttagaaatctcacttcttttccgtcttctttccatccattatatatctcacttcccgtcctaaaaagaacagtgccaataggttcggtattgccatcataccgttcaaggtatcggacagctcccatataacacctggggaaagcatacagcccggcagtgtgagaagaatatagcagaaccgatatgctgccgcgcctctctctttacagagataggcggctgtgcgctcaccgaagcaggaccatcccacaatggtagcaaaggcaaagagtaccgtagcggctgccagaaactgtttgccataaggtatggctgtggagaatgccattcccgtgagagtggtgccatcaatattttcaattcctgccgcaagattctgaaggcagatttccggctggtagacaccgcttactaaaataacaagagctgtaactgtgcacactaaaatggtatctataaaaatctctgcgattccccacattccctgtgtttttgggtctttgacgtcggattgggcgtgtgcgatcacagaggagccaaggcccgcctcattggaaaatataccgcgggccacacccatctgcagcgcttggctgatcccgtatccggcaactccgcccaccgccgcttttacccggaacgcttcccggaatatgatcccgaaggcatccggtatcatttccctatgtacccacagcaccaccaaggcccccagcagataggctgctgccatgaccggaaccagtttctctgtgaacgcggcgactcgcttcaggcctccgttcagcacataggcagttgccagcatggtcacaacacctgtcagaaagacaggtatatgaaaggcctcctccagcccttttgccatggagttcccctgtaccatatttcccataccaaaggacgcgcccagacagcagacggaaaaaataacagccatccatttacagtggagtcccctgtccatatacaccatggcaccgcccacccaggccccgttctcatctctatagcgataacggatgcccagataattctctgcgtaattggtcatcattccaaaaaaagcggaaacccacatccagaaaatagcccctggcccgcctgccatcagcgctgttgccacccctgttatgttcccggtgcccagggtagcagccagtgcagtacaaaaggactggaactgggagatggaatgctcctccttcgtttttctgacctcttcttttttcagcagggaacccagtgtggtgcgaaaccattctcctgcatgggtaatttgaaaaaaccgtgattttatggtaaaacgaatgccggtggccaggaaaaaaaataacattccgggactccagacaaactcatgaagtgtatgtaatagatttgacatacaaaaaagacctgcctaaaaagatattcatagcagtatatgtggatgctgtccaaactatgaacaaccgaaacgattaaaaaaactgccccgttcatcccggagcagttttagattgcatatgttttacagtggaattactcgaaagcttttccaacagaaccgaacagttccattttctctttgatggtagcgcagattgcgtcaaagcccggttttaataatttacgcgggtcatagcctttgccctgattgtcttttcctgcttcgatgtactcacgtgtagcagcagcgaaagtcagctggcactctgtgtttacgttgattttggatacaccaagatcgatggcttttttgatcatgtcatcagggattcctgtaccaccgtgcagtactaaaggcatgtctcctgtcagcttctggatatcatccagaacgtcaaagcgaagacctgcccagttttccgggtattttccatggatatttccaatacctgctgccagcatgtccacacccaggtcagcgatcatcttacattccttcggatctgcacactcgcccattcctacaacgccgtcttcctcgccgccgatggaaccaacttctgcttccagagataagcccagtcctttgcagacacctgctaactcttttgtcttctcaacgttctcttcgatcggatagtgagaaccatcaaacatgatggatgagaatccagctttgatacatttgtaacatccgtcataagtaccatgatccagatgcagagctacaggaactgtaatgttcagctcttcaatcatagcttttgtcatgtctgcaacggtcttgaaaccggtcatatattttccggcgccctcagatacacccaggatgatcggggatttgcactcttctgctgttaacagagctgcctttgtccactccaggttattgatattgaactgtcctactgcatagtgtcctgcttttgcttttttaagcatttcagctgctgatactaacataaatctaacctccactaattgaaaattctcgcttttcccatccctgcccaaaccatcggcctgttcattaggaaagaacgatttgttattattataacacatttcccccttctggcaagcttttcttacgcaaatttaccaatagcggcagcgaactgctatcccttaacgccgccggctgttattccatggggttatctgtttttatttacagccgtatcttaaaatcctcatacccaaacgccttcaccacctggcactccccgttctccctctccactgcgattgcaggcaggcacattccgttaaaggtgttattcttcaccatggtatagatcgccatatcgccaaattccaggcgctctcccacggacaggggatgttcaaaggaataggttcctatcacatcaccggccagacaggtaggccctgccaaacaatatgtatacgggtattccccttccctgccacttctggcaagcggaggccgatagggcatttccagcacatccggcatatgacaggcggcagaggcatccaaaatggcaatattcccgtcctgaaaaaaggtatccaatacccttgtaagaagcactcctgcatttaacgccaccgcctcaccgggttccagatagactgtcacccggtatttctcctgaatgtttctgatacattcctccaaaagcgggatgttatatcccggcctggtgatatggtgtccgccgccgaaattcacccatttcatccggtacaggaattcaccgaatttctcctccactgcatccagcgttattttcagatcacctgcatcctgctcacagagtgtatgaaaatgtattccctccacaccatccagaaactcaggccgaaacctctcccttgtcacccccagacgggacccgggagcgcagggatcatagaccgcatggccttcctgtgtggaacactggggattaatgcgtatccccatactttttcctgcggccatcacccggtctctgtacctgtttatctgctcaaaggagttaaaaacaatatgtccgcagtaagaaagaatctcgtcaaactcttcttccttataggcaggggaatagatatgattttctttccccatctccttggctcccagtcttgcttcaaataatccactggcagttgtaccgcttaaataatttcctatcacgggatagagcgcatacatggaaaatgccttctgggccagcaggatcctgcatccggtccggtccatgacaccttttaaaacgcccaggtttttttccagatccggcaaagaaaccaggtagcacggggtgggcagttcatctcgtctcatagcctactccaccagacaggggttttcagatatccggtacggaagcccccattcatttaacgcctccataaagggatccgggtcaaactcctcaatattgtgcacgcccggcttgttccaggtgccgttcataagcatcatggcaccgatcatggcaggcacgcctgtggtataggacactgcctgagaacctgtctccttatagcattcctggtggtcacacacattataaatataaagctttctctccttcccgtccttctttcctatgaagatacatccgatattggtcttgccttttgttctcggccccaaagttgccgggtcgggaagcactgcttttaaaaactggagcggcacgatctcttttccctcatacaggatcggttcaatggatgtcatgcccacattctccagacatttcagatgtgtgagatagctctctccaaatgtcatgaaaaagcggattctcttgatccccggaatattcagcgccagggactccagttcctcgtggtggagcagatacatatccttctcccccacttcctcaaaattgtaaacgcgtttgatctccatgggttctgtctccacccagtgaccgtcctcccaataggagcctttggcggaaacctcccggatgttgatctccggattgaaatttgtggcaaagggatacccgtggtctcccccgttacaatccaggatatcgatgtagtttatctcatcaaaataatgtttcagggcgtatgcagagaatacacctgtgacacccgggtcaaatccgcttcccagcagtgcggtgataccggccttctcaaatttctccctgtaggcccactgccatttgtattcaaatttcgacgtatcctccggttcgtaattggcagtatccacatagtgggtttttgctgccaggcaggcctccatgatggtcagatcctgatatggaagggccagattcaaaaccacctggggcttttccctcttgatcagagctgtcagctccgcgacattgcccgcatccacctgcgcggttgtgatctttgtctctgtcctgccctccagttctgcctttaatgcatcacattttgacagtgtcctgctggcaatgcagacttcatcaaatacccggctgttggcacagcatttacggattgccactcctgccacaccgccgcagccgatcaccattacttttcccatatttttttcctcctgtggtttacttttttatgaaagcatgaggtttctgtttggccggctggatatttacagcgcaagcagcatttccctcacgatttttcccgctgttgctgtggacactccgctctggtcaaaaggcggacacagctcatttacatcacatgccacaaccctgcatcccctgcacactgccagaactgcctgcagaagttcctgaaaggaaaccccgccggcctccggagtccctgtcccgggaaatacagaggggtccagcacatcaagatccagtgtaaaatacaccggtcttcccaaaagtctgtggatcacctcagaatgcccatccaggtcaaagggatgcatcttcacatgcccatcctctgcccatagaaattcttccctgtcgccggaacggatgccaaactggaaaatgcggtcatctcccaccagctcccagcaccgcctcagcacgcaggcgtgggaaagctccaccccgagatagtcctcccgaagatctgcatgggcatcaaagtgtacgatacacagatcaggatatttcttcactgctgcacgcacgcttcccagagtcaccagatgctccccgcctatcataaaaggcagctttttatcctttaaaatttctccggcccggccttcaatctccgccaaaacccgcacggtatccccaatgggaagttccagatctccgctgtcaaatattttaaagtccgtcagatcttttttctgataaggactgtacgtctccagcccgtaggattcatttctgatggcctggcttccaaaacgggttcccgggcggaaggatgtggtggaatcaaaaggcgctccaaacagaacgatccgcgactcctcatactccccgtcacatccaataaaattcacaatatttttactcaacatcttttaacatctcctccacataagccggcagtgcaaagacgcccgcgtgaagcctgggcagataatatctggtatgtattcccaaaagcttccaccggaccccgtccaggtcatccaccggatgatatttttttgaagcaaaaccgaacagccagtgtccggagggataggatggaatatgcgcctggtataccctgctcacaggaaaggattccacgatcctcttatgcatccgaagacaccagaaagcctcctcatcgtaaaaaggactctcgtgctggttgatcatgattccatcctcgtgaagagcgttgaagcagttcccgtaaaattcttttgtgaacagcccctctgctgccccgaagggattgggggagtcaatgatgatcagatcataggcatccgaacggctgcggataaacttcaggccgtcctcatgatagatattcacccttctgtcattgaggctgcaagccatctgcggaaaataccttctgcagacttccaccagaagcgggtctgcctccaccacatcgatctgctccacatcctcatattttgccagttcccggacaacgccgccgtcaccgccgccgatgacaaggatctgcttcacattgggatggacagccatgggcacatggcttatcatttcatgatatataaactcatccttctcggtcagggccaggtccccgtctaccaccagtatctttccgaattccctggaactcagcacatccagccgctgcagctcactgttggcggaaaaaagctgttcatccacccggatggataattttacatttggcgtgtgcacatcggaaaaccacatttccatcatacagcccctcccttcagcacattgagatgcctgatccccgggtcttcaggtcctgtcatggaacatcctttttcttttgcatagactatgtaatccaaaatatcctctgttatctcttccccgggagccaggatcgggattcccggtggataacacatgacaaactcactgcatatccttccggctgtctgttccaaaggcagggattcctttggcgcatagaaggcttcctgaggcgttgccactaccttgggatctatatattcctgagacagcatgccggcccggtcttttttgtacctccgctttacctccgccagggcgctcaccagacgctccacctcctgtctgcggtccccaatggacagataggccagaatatttccaatatcaccgaactcaatctggatatcatactcatcccgcagaatgtcatagacttcgattcccgcaagtccaatctccagggtatgtacagagagcttggttcggtcaaaggcaaagatactgttgccgtttaccaggtcctgggaaaaggcataataaccgccgatattgttgatctcctctctggcatattccgcaagatcgatcaccttctcaaactcccggcgtcctcgaagagccagatttctcctggagatatcaaggcttgagagcagcaggtaggacccgcttgtggtctgggtcagattgataatctgccgcacatgtccgacactgactcccgggcctgtcagaagaaaagaactctgtgtcaggcttccccctgacttgtgcatactcactgccgttatatcagccccggcagccatggcggatacgggaagaccctccccgaaataaaaatgtgttccatgggcctcatcagccagcaccaacataccgtgttcgtgagccagctttacaatagagcgcaggtctgaacagactccgtaatacgtgggattattgacaaacacagccactgcgtccgggttgttccgtatggcagcctccacctgttccagccgcatgcccagggagattcccagcctgcagtccacatcgggattcacatatattggctgcgcaccgcagagaaccaaggcattgatggcacttctgtgcacatttctgggcatgatgatcttatctccccgcttacagcaggataaaaccatgctctgtacagaggatgtggtccctcccaccatgaggaacgcatgagccgcgccgaatgcctctgccgccagctcctccgcctctctgatcacagagacagggtggcagagattgtccagcggcttcatggaattcacgtcgatccccacacatttttctcccagaagttccaccagttccggatttccttttccgtgcttatgtcccggaacatcaaagggcacgacccgcattttcctgaaacgttccagcgcctcatagatgggcgcccgttcctgattcaattctgacatttcgacctccttttccgattcctgcctgcacacgggtgtgctgtaattttgaacacaaaaaaagcaagcaggatcgtatacatagtcctatgcttgcttctgttcatttttatagaaatccaccgctccccctgctcataccggccctcaaataagacccgttcagggtaaacatggcttttattcttttttataaaaacagatatggtttagagtctatatagcaaatatttatacttttaatactcttattgaccgtttcacaagtttgacgttttgtatacgcactagttataaagtaaccaacttataaaatttgagcttctaactcaatcaataaggcaattaaattgccggaaatatttgcatggaaatcttcacctttatctgtcttccatacatgccatactttaccacagctttaccaaaatagcaagaaaaatatggagtatgtttacaaatttctgttttcactcctggatatctatggtatgatatatttgtagcaaaatttctgattcatatggaaagtccagctaagaaatgtcaataggtaaaatgaaaaatgttaaaaaagtttttttcaagcagttgatgtaaaaaagggtaactttaataagcccacccatgtggaaatctttaaaattcatgataaacctgttaggctgcgttctgtatcttgtcgggatgcgctgccagataccgctcacagtgttcctgaggagtgatgatctcaaatggtttattatcccggagcatggcaaaaatgatattgcagattttatgcatgacagccccgacagccacgtttttcttcttgcttttgcatttgtcggtataatagccgtggataactggatttactggtgtttttgtccctttatccaccttaagattattgatagccaccatatgcaggatacgcctggcaaggctagaacccctcttggacatgtggactttatccccattgaacttgccggattgcttcacggcaggatccaagccgaagtaagcataaagcttctttggggaagaaaacaggtcaaaggagcccatttcagcgatcaggacggctgcactgagaaaaccgacaccacgtagggactggagaaggaagatacggtcataaaccggcgtcccttccagcttatcaacagccttatgcaggtcctcaagtatattgtccagatgctcctggtattcccggtaggttttgatatacagtcggatccggagtgcactgctttgaagcgcacgtccgaaaacagcggcgtcctttgcggcagcacgtatggcatcatatttggaaacggcatatttttcaccgaaacgtgcggttttgcgtatggtttccacaagtatgtcttttggggcggcaagcatgtctgcggcaagggggtaagcttccagaagctttaaggaagtttgggtagtgaccttgctaaacaccttccggtatgcaggaaaggacactttcagttccgccgtgagcttcaggacgacagcggactgcaggtctttgaagtaatagtagtcccgtaccaggttgcgcaggtcaatgacctcatcatctggtatgatggaagtcttaagggaagcatccaggccgactttggcagctttttttgaatcaaatttatcattatgcagtttccttacgttcatatttgtgctattcttagtgatgataggattaatgactgagcagtcaaaccccttatcacgaaggaagtacaggagcgggatgtggtagatcccggtggactcaaggaagcagcggctttcgagggaatacatctcttgtgcttcctttatttttgcgacagcaagctcacgggactgcggatcagaatgaatgatcttaaaaggtttcccggtgagaatgccattgggcagcatgatggacatccaggtgaagtctgcaccgacatcaagcccgactgagagataagggatgctttcaagcatcataagtacttttgggtatttcatggttttatcctttctggcaggcatccatttccaaaaggtggatacacaacctagcggtttatacaggtattagcctggggcttcccaaccagccaaaacataaatcaccaccgaatggactgacagactttctaagaggtttcaccagccggaaggccggttcccaaggaggtgtcgtcaatgatcctgcctccagtgattatacctctatcttttgtctggtgcattaaggaaacctcagacatggtaaataatgttactttataacttctgatggagggggaactcctccttccgttatatctatatagatttattagattggactttgtaactattaaccagtagtcattcttgactacaccattattatactaggagggtataattgccggaatattactaactgtgagaattcccaacagttacatcaaatattgcaattatacagtggatacagaattatggaaatgaaaaatatgatcgtcggccagtccggaggaccaaccgctgctatcaacagcagcctgtacggtgtggtatctgagggccttcgccaaaaagaatttatcggacgtgtctatggaatggtaaacgggatcgaggggtttttggaggggcatatcctggatttcgaagatgctcttcccggtgatacactggaaggactgaaaacaacacccggtgcttatcttggttcctgccgctataagctgccggaggatttatccgacccggtctatccggaactgttcgcaaaattcgaggaactgcagatagggtatgtcttctatatcggaggcaatgactccatggatactgtgagcaagctctcacgctatgccgcttctgcaggcagtgatatccgtttcatcggagagccgaagaccgtggataacgatctggtcctcacagaccacacacccggtttcggaagcgctgccagatatgtagcctccactgtgcgggaaattgtcatcgacgccaatgtatatgagaaaaaatctgtgactatcatagagatcatgggacgccacgcgggctggctcacagccgcttccgccctggcaagaaagtataaaggggacaaccctcttctcatctatctgccggaaacagcctttgaccaggaggcattcctaaaaaaagtggaagaatgctttgaaaagacacctaacgtcattgtgtgcgtttccgaaggcattcatgatgacaagggaacctttatctgtgagtatgacaacaacgtaggaacagacacctttggccataagatgctggccggatgcggtaaatatctggagaatctggtgagaaaccgcctgggtgtaaaggcccgttccgttgaattgaatgtaagccagcgctgctcctcttccatgatgtctgcagcagaccagaaggaagctgttatggccggtgagttcggcgtccgcgcagcactcagaggatatacagggaaaatggtagcttacaaaaggacttgcaacctcccctacgccatcactcttggcctggaggatgtaaatgaaatctgtaataaagaaaagaccgtccccgtggaatggatcaccagggaaggctcagacataagtgatgatttcatcatctatgcccttcccctcattcagggaactgttgatgttcccacaggtacagacggcctgcccgcatttgtctatagaaaataaaacctttcataccagagaagagagaatcctgcggtaagcaagattccctcttccttatttctgtatttcgctgctgccgaaagacagcagaatatttctctgcaaaaagtcctttgtccgctcccttggcacctcctctgtttccaggtcctgaagcagatatacaaaataactcataaatccggacatcaacaccatggtcacaaatgtctccggcatatccgcgggaatggtcccctctttttttccctgctccatcagaatgtgcagcacacgttccacctggcactgagggccgccgaattttgcaaattccctgtacaaattctctttcatcttacattcctgtccctgcaggcgcataagctgagtgctgcatctgctctcactcatctctgtctcgatgaaatccagcactgccatgatctgtcccttcaggcttccggtcgttctcaggatccccatgatcttctgaaacagtttctccccggaccagatgatggccttggccaccatctcctccttactggaaaagtattcgtaagccgtaccttttccgattccggcccggttggtaatgtcagatactttaatggagtgaatatccacatcttcctctatcaggtcaatgactgcctgaaaaagtgccagttctttctcactgagcttctccttcatccactaatctctcctcatcttttttataatgacgccggttcagtatatcataaatacacggcactacaaacagcgtcagcagtgtaccgtagatcagacctccgatggtgacgatcgccattggctgcaccatatccgcgcccatacccatgcccatagccatggtggtaaggccaagaatagtggtgagcgctgtcatcacgataggacgcagacgggcacggcctgcttcctcgatcgccgccctcttctccataccgtccttgcggagctggttgatgtaatccactagcacaataccattgtttacaatgatacctgacagcatgacaaatcctaccattgccacgatactcaccggcttattccccacaagcaggcccaaaaatcctcctgtaaatgccagagggatggtgaacatgatgataaacggagagagcagagactggaattgtgccaccatgatcagatacatgaacaccagtgccagtgcaagcatctgaagaagctgtcccatggcctcgttaatactctcatcttcacctttcatttctatggtgtagccctccggaggggtatacttatcaaggatcttctgaacatcctggcttacaagtccgatattataaccggttgcaatctctgctgtcacggacatatagcgtgactggccgtccctgttgatggcctgagggcttacggagtcttcaaagtctgcgatatctcccactttgatctcctctgtctttccttccgcgttggtggtctggatggttatgtccgcgatctgttctcttgtaagagactcatccttttcacttctcacatacacatcatagtccttggttgccgtttggatcgtggtagcctttgtggcctctgcgatcttcttgttgatctcctggaacacctgcgccacggtcaaaccattgcgcatagcttttgctttatccacgaccaccttatactgggcatctgtctcctccataccgtcatccacattctgggtgccctttactttttctattttaccggccaggtctgtggcgatctcctggagctgttccaggtcttttcccttgatctcgatctgcaggccgctgcccccgagggcactcatgtccatattggaagtggagaccactacctcacagccttccacgtctttggtcctctttaaaatctccttttccagtttctcattgttcagctttttatcttccttcagtaccagatacatggtaacctgattggtggaacttccgcccattgacatggaggaaccgcctgccatggcaccgatggtctcaatatcgtctatatctgagatcctgtctatgatctcatccgcctttgcggcggtctccttcagaggtgttcccttgtccgtggtcacagtcatgctggcctgtgtactctccatggacgggaaaaattctgtacccttgcgcacggaaaggtacatacttcctaaaaataacaccagcgctcccaaaagcacccaggctttatgggtcaatgtcttatggatcatacgcccgtaaaagttctgtactttatccagaagttttgacggtttcgcctcagctctcttcaaaagtcccgcagacatcataggcaccagggtcagcgccacaacaaggctggctgccagagaaaagccgatcgtcagtcccatatccacgaaaagctgacgggtgatcccctctgtaaatacaatcggcgcgaacacgcacactgttgtcagggtggaagagacaatggctcctgccacctgttttgcgccctccacagcggcttttctggcaggtatccccatactcctcatacggtatatattctcaatgaccacaatggagttatctaccagcatacctacaccaagggcaaggcctgaaagggatatgatatttaatgtcactcctgaaaaatacatgagcaccagagctgtcaccacactgataggtatggagcaggcaatgacaaaagtcggcttaatatcacgcaggaataaaaacagtaccaaaatggcgagaatgcctccgaagagcatattctgcagaacggaattcaccaccatatcaatatagattccctggttcatcagcgttgtaaaatgcagaccgtcatttcccttctccagttcatccatgcggtccaaaatcttatctgccacttcacctgtggaatatcctgtctgtttttctatggaaagcatcacgcccggattgccgttgatctttgcatatacatccgcagagtcatctgtgacactaatgtctgccacatcagaaaggcgtatggacgccagtccgtccagcttcagatccagcaggaccagatctcccagactgtccacatcctgcaccttgtctccaaccctgaccagatactccttgccgtcttccgccacatagcctgcgggcatggcaaagttctccgctgtgagaataccttttaccatatcagacgtcaggatggtattcagatccgccttatcctgggcctgctcttttgcctcgtcaagctgatcccttcctgagtcaagctgggactgggccgcctctaactgggctgtccccatggcaatttttgaggaagcggagctgagctggatagaagccatgatcttctgtgtttcaagctggatctgggctgcgctcatctgggactggcctgcctcgatctgggcttttgcctcctgcagcttctggatccctgcgcttaactgagtctggccttccacaagctgagctttggcacctgcgatctcctgcagccctttattggccgcatccaggcctttatccactacctctacagggtccagcttagagagctgttcattcagtgccgcaagctgctgctccatccctgccttttggttctccatctcctctttcgcagcagtcagctggtcaatggcctgctgccactcttcatctgtcatactgtcaggcttctccggcgtcagggcacttaactgtgcctccagttcctctatctgtccctggaccgccgcaattccttcctccagcttttggcttccatcctgagcctccagaagtttattctttgcctcagtcagtttttccacagtgaggttcagaccctcctctgtggcctgcaaaagttttgactggctgtcaagctctgcctgcttgctctccaggttctgaagctgcacatccacctctgccgcacttttggtcagttcactctgtgcctgtgagagctgtccgcttccctctccgatctgggatgccgcttcattctggccgctttccagttcactctggccgttctccagctcacttctgccggaatcaagttcggcctgggcatcttcaagcttctgttcctcctcggcaaacttaccgtttatagcgtcctgaaccttctggttcatggcatccagcttttcctgatcgatccgcacttcaacgctctcggtgacgccgccgctctgggaaaccctggcaaccccgtcaatactctcgatattgggctgtacgttatcttctatgtaatcggtaagttccgcggctgtcatatcatccacatccactgctgccaccagaaccggcagcatatctggattcagtttcatgataatgggattgctcacggaatcatcccaatatccctttatctgatccagattctccctcatctccagtgacacggaatccatgttggtagtctcctcaaactccaggatcaccagggatacattttctctggaaacagagcttacattcttaatattactgactgtcgccatactctgttcaatgggcttagtaacagtctcctccaccgattccgggctggcgcccacataagtggtcattacgattgcatagggcagattcatactgggaagtaaatctgtgttcatctttgtcacagacaccactcccaaaagaatcaccagcaccaccgccacaacgacggtatagggctttttcacactgaaacgtgataacatttgaagtcctcctgtattctttatggattgaccgactgaccggtcagtctaatgtaaaaattatatgtctttacaggataagtgtcaacaaatctatttattaaagttacataaacttcttcttatgaaatacagccccggcattttaaagtaccggggctgtatctgtattcacaggaaagcttttatttgtcatagagatgacaggcaaccagatgcccgtttccgttgtcctttaattcagggatcacggtgtcacatcccttggtctttttaaaacagcgggaacagaaacggcagcctgcagggggattgatgggagtggggacatcccctgtcagaatgatcctttcttttttctttgtgatatctgtagaaggaatggctgacagcagtgcctgggtgtaagggttcagcggatcatcatagatttcacgcttatctgccacctccatcagtttgcccaggtacatgactcccactcggtcactgatgtgctttactacgttcagtccatgggcaatgaacagataagtaaggccaaactcctccttcagatcatccagcaggttcagcacctgtgcctgaatggaaacatccagggcagataccggttcatcacagacgatcagcttgggctgaacagccagcgcgcgggcaattcccactctctgcctctgtccgcctgagaactcatgaggataacggtttctctgatggtttgcaagacctacacagttcatcagatatgtcactctgtcctccacctgatcttccggcatcagtttattgatacggatcggctcaccgataatatcaccaactgtcatacggggattgagggacgcgtacgggtcctggaagatcaactggatatccttacagtatttccgcctctcctttgtggagagcttggagatatcttttccatcgtacaggatctcacccgcggtgggcttatatagatccaccagcattttgccgatggtagacttgccgcagcctgactctcctaccaatcccagagcctctcccttatagatcttaaatgacacatcatccacagctttcagaacagcggtgggttttccgaagaaatttgtctcaacatcgaagtatttttttaggtgcttcacctccaaaagaacttcttttttctcttcactcatcttactcaccctccacttcatcacttatcaggaagcaccttacttttcttccgtcttctgtccgggccagctttggcatgtgctctttacatttctccatacatttgtcacaccggtcagcaaaagagcatcccttgggcagatggatggggtccggtacgatacccttgatcatatacaggcgctctttgtcctcatccattttggggatggaatccagaagtccctgtgtatagggatgcagtggttttgtaaagagctgctccacggtcgcctgctccaccacacggccgcagtacataaccaccactttgtcagcagtctcagccacaacacccagatcatgggtgatgagaagcactgccatacccagcttttctctcaggcggttgatcaggtccaggatctgggcctggattgtcacatcaagagcggttgtaggctcatcggcgatcagcagctccggatcgcaggccagcgccatggcgatcatgacacgctggcgcataccgccggacatctggtggggatagtcattcactcgctgttccggtgcgggtatacctaccagatccagcatttctatggctcttgccagagcctcttttttactcatggtggtatgtgtcagaatcgtctccatgatctgatccttcaccctatacaccggattcagggaagtcataggctcctggaagatcatagagattttatcgccccggatcgcctgcatctccttagtgtttttctttagcaaattctctccgccaaacaggatctctccccctgccacacggcccgggtcacggatcaatcccataacagaaagagaggtaacactttttccggaaccggactctccgactactgccaggatttctcccttgtccacttcaaagctgacaccgtttaccgccttgaccgtacctctttttactttaaattctgtctccagatcttttacttccaataacatgatacggtcctccttatactcgttctttcgggtccagtgcatcgcgcaggccgtcgccgaacaggttgaatgccagcactgccaatgtaatggcaagacccggaaaaatcagggtgtagggcgcagagaaaatataggttctcgcacgtcccagcatatcgccccactccgccatgggaggctgcacgcccatgcctaagaatccaagagctgctgtatccaaaatcgcagtggagatacccaatgtagccctgaccacgatagagcttaccacgtttggaaggatgtggtggaaaatgatcctcctgtcagagtttcccacaaccttagctgctgccacgtaatcattttccttgactgacaaaattgagcttcgcacaatacgcgcatactccggaatggacaccgtaccaatggcaatgatggctttgtcaagccctttaccaagggctgccatcagggtgatggccagaaggattgacgggatggagagcatgacatccatacatctcatgataaaggaatccacctttccaccgaaatatcctgccacagagccaagaacggttccgatcagcagagaataggccacagcggccacacctacaaaaagagaaatcttagtacctgaaagcacacgtgaaaagatatcacgtccaagctgatctgtaccgaaatagtaatccttgcagggtgccacaaatgtgtgccccatgtcagaatactccggatcatagggagccagccagtctcccatgacagctaaaaacaggaaaaacacaatgaccacaagacctgccactgctgctttgttctttttcagagtgtcccacatcacacgaatctgggattctggtttttccagtgcctcccctgttgtctgtacctgttgttttttccgcatgacagttacacctccttcttctcgaatttaatacgcggatccagaaacgcatagatcacatccacgatgagattcatcaatacgaatatcactgcaatgagcaggaccacaccctgtaccacagggaaatctgatttcatgatacactgtactgtataattgccaatgcccggccatgcgtacacagattctgtcagcaccgcaccgcccagaagggagccgagctgcagaccgataacggtagtgacaggaagcatggcgtttctaagtgcgtgttttctcgtcacttttccctcactgataccttttgccctggctgtacggatatagtcctgattcagggtctctaacatactggagcgtgtcatacgggcaatgatcgccatggaataaagactcagagttactgccgggagaaccatatggacagcggcatctttgagagctgttgtatctccctggataatactgtctatgatcataaaaccagtcacggtatccggacgcagggacgggtcaatacgtccgctggaaggcagccagtgaagaacaccggaaaacaggatgatcagcatgataccaagccagaaaataggtacggatacgcccaccagagacagcagcataccgccgttatcaaaaatggaattcttctttaccgaagacactacaccgattattatgccgaaaatggatgccagaatgatcgccacaatggccagttccaccgttgccgggaaacggctggcaatctcttttgtcacaggcgccttggtgtaataggatgtgcccagatcaccggtgactgctccttttataaagtttacatactgtgtgaccacaggttcattcagcccattggcttcccgccattcctccatactctccctggttgcgtgctgacccagaacgataggcgcagggtccggtgcgcatacacgcataaggaagaacacgatcagggatacaccaaagagaacgggtatgagctgtaaaagccgttttattatgtacttaaacatgtcttgacctctctttattcttttgttgaatttcttcggaacaattcatttctcaaggggttaacctgcagagccctttcagaaatgaactgttccccggtagaacaggcttttagaccgcatataagggcagatttctctgcccttatgcaatcccgttttacctgatcagttcttatatgtcttgctcaagaaaacatttcctgtcggatgtgcgatgaagttctgtacattagatacatagcctgacaggttctgctgatgggaaatcggcagccagacattctcgtccgcgatcttctgttccatcttggcatatgctgcatttctgtcgtcaccattttccatggatgctgcttctgaaagcatggtattgtactcttcattgcggtacagggcaacgttcatttccgggtcctcatgagctaacagatacataaagttatccgggtcaccattgtcaccgatccagccgtacagacacatgtcataatcgccggcgccgagtttttctttgtatgttgtccagtcataggaatcgatggacacttttacgcctactttgtcaaaatatccctgcagagcctctgccaatgtctggcctgtggctgtattgtaaggtcttgggtttgtataagccatcatcttcagttctgtgatgcccttttcttccagaaccttcttagcgtcatccggattgtactctgtctgttttacgtctgcactgtaacccggcataaaggtaggaagaatgctggtagcctgggaagcgtatcccttgtaaaggctctcaaccagttccggcacattgactgcttcagataatgcttttctaacctcaggatctgttactctctgggtgttatatgccatgtagttgatattcataccctctgcctgatataacagacagcctgcagacgtgatctggtcaactacagtagcgtcgataccgtcaatgatatccacttccccatttgtcagggcaactacacgtgcggagttatccggaattgttgagaagatgatctctttcgcaacacccttgtcaccccagtagtcttcgtttctctccataactacagcttcattcttatcccatcttacgaacttgtacgggccggttccgcatggagcttcatttaagtttccatttgccgcgtcacatgcagtggggcttaccataggagcacccagggacatagccaggttatttaagaacggtgtggattttttagtgagcttaaattctacagtataatcatccactacgttgcactctgcaacatcgccatatacgaagtcagcgtaaagcatgtcctctgttttattgacagtctgtctgtcaacgttatattttaccgcttcggcgttgaagtccgttccgtcgtggaattttacaccttctctcaacttgaaggtataggtaaggccgtcctcactgatctcccaggactcagccaggcatggctcaacttctgtatcgctgtcgccgtacttcagaaggccttcatacatctggcagataggtttggaagattcaccgtcatcgatcatagccggatcaagtccacggggatcagcgccctgtgcgtatctcagtgtctgctctttgtcagcatcttccggaacgtcagcaaattttgtcagcatctcgccgcttgcttttttctcggttgttccggcttctgtctctgcatccgcatttccttcatcaccggtagtttctgtctttgttgtgtcactggtattgtctgcaccagtcttcttgttgcttccgcatcctgccatcatggtgatcgccatagacgtgcagagtaaagccgcaattacttttctcttcatagaaaatccctcctttgattcacgcagtattccctgtgttctgtcattttgacatcactttgacgtggtaaacacaaagaactctgtgctaaccattttactatagaaagagaaaaattacaagttttaatttcttttcctgcatttatggatttgttatgcaacttcttttttccccgtttcaaatcaaatccgagccataactgctgtccatttcataattactggatatttacttttatttttttgcaagttctcctcttttttcctgcattttattcgtgtaatattttacatacccaatagacaaatacacatttgtctttttgtcaaagacattttcatataaaacattataattttctctgttttcattgcaaatgtctttcattaaaagacaaatcttatactcatttcaacagccgtttttatattcctctgttatcctgcaagtaatagtcaggatatgcaaaaacgctccccagatggacaaatatacagataccatggatatacaacgactggatcacatccgaattcctctgcctgttatttctaaaatgtattcaatagtaggatttatcatatgcctgaaccggcatagagatataagacagggatgccgcatttagatgactgcagcatccacttttagaattttgaacttacataaaaattaaccttcttagattttactcatcccatcaataaaatccgcaagggagtctgtatgtgccgccaatttcagatattttaaaagtatatccatatccttttcttccagaatattctttctgagttcatcaggtacagggccgaagtcatccagcaaaaacagaatggattcaatttttccctgcgccagcccttttgcttctccctcggcacgttcctccctcaacaactcttccagcaacataaacctctcctccatttcccggctgccttttattcttgccatagactcctggatttttttcacaaaaccatcctggtagtccttggtactgcccgctaaatcagccttgacaaatttcagaaaatttacaaggcctgcaggtacttcctgatctctaccttttcaattggaatgcccactgccatttcgagaaaatcccggcagatttcctcatctgccataactgcgccaaacataaaattatctttaaacatcagttgtgccagttttctattttcactcataagcaacctccgcacaggcagaggaattcttatttgattatatcataatatggttgaaattttcacctataattttgcatttgcaaagtaattcattatatatcatgcgtgtccgctggcaaatttcagcagttcttttcacaacaacaaaacttctgtatgggatttccccatttatctttcctgtatgctgaccttgatcatatcccccggctgtttccctgttttttgccggatatctttccttattcctataatgtggccgggtgttttcatccgtaccagacttccgtcataaggctcaccgtcaaaggtggcatggacctttacccttcctttaccgaactctttgcgtacatcaaaaggaaattcaatatatgccccatctatgtcaggcactttttttataaccgcctcaaattcatatactcttgtattcatgcctaatcccttcactattttttagacagaagcccccttacgacttcccacaggtctttataaaattctgtaaaacaatttaaaataaagtttttccacataaaatcgtatgtctatatgtttctgtaaaagatttttttctaaagttgaagtcgagacaaaatatgcattgaaaacagggctttccaaacacagctattaaaagggcaaaaattattacctatcatttaaaactaacttttaacagcgtaacaacttgttggaaatacccccttctctcaatcaattaatcttttttaattctgacataatacttatattcatcttcgtgttcgatatatccaccgttatacaacataacttttaatgacgccgtattatttctattcactctcaaatatacctcatcttctggaataatcgtttttgctatctttaatgttaatttaagaccttcttttgcaaacccttttcctctaaaatccttttttatgaaatatcctatatgtcctcctccaactcttaatgattcgcaaagataatgacgaatgcgaaattggcctacaattttatcatcattccataaaaacaaaaatgtttcaggtacataaccctctggcagattgatgccttttgaaaaatcaatcatttgatgaagtgctttttcttcaaagtttttgcgagtgataccatgccacgtatttgtaaatccattttcatccattggcatatcccgaacaaaaacatattctttatctatatcttcataatttgcttcttttaaatatatcatacaactcacctcctcaaactgagatccatcaatttttgtatgaatgtattataacattttatattaaatttttctacttttgcaaaatggcaagccctattctcatctgtcagagagaagctaatggatatttttcttccgatatgcagcccacaacaaaaaaagacaatctgaatggcttttatccactccagactgtctcctattttccatcaataaaatctgaccaaaacctttactcagcaaaagcatctttcttcatcatttccaaataccgcatggtgccctcgtcatccttttcattataaggataccccaaatgcgcacccactttcactgccaggctgcggaatagatcacagccgttaaaaaccgcctgccacagatttgcgtgatccgcatcggaataagtagtacaatacttttcataaaggtcaatggataaatacttcttaaaatattttccccacatccctgtagagacagaaaaatcatactccgccgcaatataccactccaccattttttcaagctcagcatgaacgacctggtgatacattctccatgcgtaaggcaactgatcacggactatccctttcgccacattgttaaggcaccaaaaaaactcattacagcagctctcatactgcgcctcagatggtttctttacatgatacagactatcattcggctctgggatctggggcagcagaccatccttatccaagagcttgacacagagcgtatccgacagataattctccacagcacacgcaggtgtctttatacacagatctatacggttcccgtcttcaaacagcataagccaggtataagaagacaaaagatccagttctatgccccccatatcattccgatccggctcctgtacaatggccgttttaccaaacacggaaatccagttccggtcagcgagaaaggattccgtttccctgaccacatacacaatatcaaaatcccggtatttgtccttggccacattaggatttgtgcgggacccattcatatacacagccctcacgcgctcatcctctttcgccgtctcaaggatcagatcatacatctcccgttctgttctcatccgcattcccatccctccgtcattaatgtacacaacaccttcgctcactgtcaggcaaacaataccttcagtgtagattatcctatagtatttgtcaactcataactgtccaattataactgtccaggtaaccgttcaaccgttcagctttccactgtcccgcgaggtgttgtcttgtttcattccacccctctcatatacagatccatagcctctgccactttcttagaatgcgcaaccgcctccaccaccgtccttgccccgttcaccacatctccgctggcgaatatctcaggccgggaggtatggcctgaatcgtctgtcacaagcagtccaaatacatccgcatctaaaccgggggtagttctgaccaactggttccgcggcccctggctgatggaaacgatcacactgtccgccggatagagcttttctgtcccttcgatccggcagacactcccgccttctgtctcttccgtatccgcaaagaccactccctcatcccggatctccacaggcatcttgcaatagacaaattccactccttccagcacggcatagtcatactcacttttactggcagccacggaagaatccctggaaaaacactgcagctgccgcactcctttgcgcagcgcagttctggcaacatccatagccgcgtttccggcgcctatgacgatcacccgttcccccagatgaaaactgtccggattattcagataatggatcccgtagtgcacatgccccagtgtctccccttttacgtgaagcgcattaggcctccacacacctgtcccgataaaaatagacttatagccgtcccggagcagatcgtcaatggaaatagcccctcccaccgcagtgtttggccgtaccttaatatccttcagccacagatggcgatactcgaaatcatccaatatacttttgggcaggcgaaattcgggaatcccgtatctgagcacgcctccaatcttatccttgctctcaaagatggtcacctgatatcccttccgggccagcagcactgctatcgtaagccctgccggaccggaaccaatgatggcagcccgcatcccgttggaggctgccgggccttttaccatcttggagctgtaggtgctggaaatatagttttcgattgtagaaaaatgtacaggcgcgccttttcttcccagcacgcagtgtccttcacactgtttctcatggtcgcagatcagactgcagactgtggtcagcggattattttcaaaaagcttccaccccgcctcatccagacggccgtccagcatcagccggatgaccgacggaatcggtgtatggatagggcagcccttctgacattgagggtttttacagttcagacagcggttcgcttcgtccagtacatgtgcagccatatccttttcctccttttattttccttccctcttaatacggagatattccacgtttgcctctactttctttttcgacagcggatatacgaatatcagcatcagcgccacacagagaaagaggattcccggcacaaccgttgccagtttgtaaagaccgctcaaaacctctgcgctctgggtcttagctgttgagacatacccgataagtcccagcgcatagccgcccagacctccggccaaagcctgacctacttttctggcaaaagaataaaccgcatagactgtaccgtcttctctctttcctgttttcacctccacatcatcaataacatcaatgatattagcccagatgatcaggttgaaataactcacgcccaaatatcccgctgccgccaggaccacgaacagccacgcatttttcacattcataaaccctaatatcaggaagacaacacctgtaaaaacagttgccgcggctgcggattctctttttccgaacttcttgaccgtgatacctgtgatcgttgccatgagcagggaacagagcattgtgatcatattataagaagacagtgcttttacattaccaaaataatcggcgtacagatatgtattgacgctggacatcatcagagagctgagaagcaggaaaatagctgctcctacgatgcccaaaagcgcccggttggaaaaaatagcaccaaatgtctttgccagtgaaatcctctccgcatttgggtccggttcgatcttaatacgctctgtggtgcatttgtagcagataaaataacagataatggcacagatggaaaagattcctgccacaaccggaaatatttttccgtcattgcggataacctgcacaccgtttgcgtctgtgacatagatgatcatagggccacccacaccgatgacaagctgggccagtgtagcgccgatgcttcggaatgtggaaagggcggtgcgctcctccggtgcatctgtgatcgcagacgccatggatccatacggaatattaattcccgtgtaacagatacttccccagagaatatacgttgcgtacatatagatcatctttaccgtcatggaggcgtctgccagggcggactggtacatcaaaaaactggcaagcgccaccggaccggccatgatgcggatccagcgtttaaatttcccgtctctgcccggtttgcaggtatccacaatacgtcccatggtcacatctgtaaaggcatccacaaatctcgccactaaaaacagagttcccacagcccccgcactgatgcccaggactttcatataaaataccatcagaaaggtactggaaaacataaatgtgaaatcatttccaaaatcaccgaacatatatcctatcttatctttcaggccaaatggctttactgtcttttcattcatttttatcaccccctagaatctggtctcccatcttccgcagaaaacattttcattatatcttcccttgaattcactttttcccatcatcttctccaaggttgccgcaaagctctcatgatggtccatataggaattaatgtagcatctggccataggcacatcgatcagattattggtattgctcagagataccacaaaggtaggcagttccgacatataccagggctgttttaccggctcatcccattttacacgcatggtattatactgggcaaatccctgtacattgagaaccagcagaacacagtcgtactgtctcttaaagtcctctattttccctttctttgcgggtacaccggcatccacttcaaagccggccccttcaagctgtgacacaaggtcagagataatatttttgtcattggactcaaatttcattcccgcaatgaccgtggcttctgacccgatatacatgagcttgatcctcttatatctctttggtgtcatggggagataatgcaggcggtctttcacaagcgtcacatacttgtcggcaaactctctggatgccttgtgatgttccgcacaaccaaccacctccagattttcttttggcgcagtcagtttaccttccttctggagcttgtggagattcagggcagcttttactccaagtattctgtgaagggcgtcctgcagacgttcttctgtgatgataccactttgatacccttccatcatataagcgaaatcttcctctctctcattgaagaacaggaacatatcacatcctgcggcaatggcctggggaacctgccggcttctggggatggttgctccgaacatgccgatcatatgggaggcatccgtaacaaccagtccgttaaagcctaattttcctttcagcaggtcagtgatcagttctggtgccagggtcgcaggacggatatcctcatctttgataccggggcgcagttttctagaatacgcagggagtgctatgtggcctgccatgatagtcataaccccttcatcgatcagctctttatagacttttccatacgtccggtcccatttatcgcagtcatactcattgatgcccatgatcaggtgctgatcgttttcctctgtgccgtctcccggaaaatgcttcatgcaggtggcgatattctgtgtcttcatacctttgaaaaaggcttttgcatagcggatgacatcctcgggactgtcattaaaggcgcggagctgcacaatggtatttctccagttatagagaagatcaacaaccggggcaaaattccagttgcatccaacagcagcagcctcccttgctgagatttccgccattttgaacacttcctccggggaatctatggccgccatagcagcgccgttggcaataggcgttcctccctggcagccgccgtttcctcctgcctcacagtttgaggcgatcagcagcggaatttttgtagtcttttgaagacagtccgccatttcccacagttcttcctttggcgcattgtgatagcggatggctccgggatgataggtatccagtacctttttaatattttccggttttcgttcctccgcatttgccaccatattgacaaaaagctgccctattttctcctctgtggtcataccggcgatcgtatcttccacccactggatctgttcctcattcagataatacggtttttctcttaaatttaccatgatatttctttcctcctgatcttattctgtaagattttcaataaagcttttgatcaatgcctcctggaacgcacctccgaatgtgccctccttcattctctctgccgcatccagaatcccggaccagctcatgctctctttggataccaaaataggataaaagaaaacattgttgtcctttgccgcgtccatgtcgccgggcgcatcccctgtcatcatgacatgttctctttcatatccgtaagtgagcagtttgctgatgcagcttttcttagaacctgcgttttgtgccagcagtacatccacatgttccagaagaccgaaccgtgtccactcctcttttaccgcctcgcagttggctgaggagacaatggcgatatcacaggtttcatgaagcttttcaatactctcttttacatgcgtaaagggtttgatctcctcttttgggatctgtcttatggattcattcaccgcctctgaccagctcagtgcttttttcagaatcggactatccgctgcgtctatggctttttccagtgcagcatttgacagttcgtctgtcttatttacccactgaatcagggtatccacatcttctacaggcacatattttttatggacttcctccaacgctttcgcaagccctttaaaacggttgatccctcttgtcatggaatacagattcacctgattccagcgctccagaatttccttttcgtgtgtctccaaatgccatttctttaccatgcacgggccaaaacacctaaaatgcttgatgtccatactgtctatggcacagccgtccgaatcaatacataccaggtgatcatgcctccttgtaaaatctgaaaaaggattgttcatactctcacgacctttctttctaattttctcttgatgtgttcaagacccgcaggcctgctgaatcgttatgtttaaaatactatagtttacagttttaaaaaataataatatccattgaatttagcacaattttatggtattttatttggtagatgaatattatattattttttcttaaaatcataccaaatttcgaggtagacatatgaaacataaacaactggaactccttcagcaggcggtgaccgcctgcagcgtgggatgtcatattattttcagcgacaaatccaacctctcccagacagacaacggactccgtctccgcctttatgaagactatgattaccagcctttgctggtacttctggaacaatatgtgacagacgggaatattgtccgatacgaagattcctttggaatgtattatattttcctgcacattccctcctcgtatctatatgactatgaatcctcctattttgtcattggtccttacctggaaaaccaaccggacacagaacagatccgtgatatgatggaacagcgcagcatacccggccgccttttttctgatatccgcattgtctattcctccactccggtcctgcacaatacaggaagcttcgagtcattggtcctgaaccttgcccagggattatttcacatggaatataatgtatcccatctcccggacaaaaatgaaatccatatagaacattcccctctgatccttaagcttcggaaagagccgcagcttaccatcagcaccattgaggagcggtatgaagtggaaaataaaatgctggaggctgtctccaaaggggatgaccggcacgcccacgaattttaccaaaaattccagacctatcagttgaggcccagaacagacaatgccatacagaacaagcgccatggagtggtaatcttaaacacgttgtttcgcaaagcagtggaagccggaggcgtgcatccattatatattgatgatctttccggaaaatttgctattttgatcaacgaagcacgtacagagcgggagttggaccatctgtccacagatatgcttcacaaatactgcctgctggtcaggaatcattccatgaccgggtattccaaggtggtaaaggaagtgatctcttatattgattttcattatgcggaggacttaaatctgacattttttgctgaaatgttcagcctgaacaaaaattacctgtccgggctgtttaaaaaagagacggatatcacactcacagattatatccaccaggtacgaatccggcgggccatcaccatgatcaactcttcctccctgcccatcagcacagttgctgcttcctgcggatataacgatatcaattattttatccggcttttcaagcgcacttatgggatgtcaccgaaacaatatcagaaatcaattctgcatcccgagtaaatataatatttatagaaaaaatgtatgaaattgtttgtataaattggtaattttctcccttatgtgttagaatatatgcatcagttatagaaaatactaaagacaaaatgtcttcgtcaggaaggaatgagagtatactcgtgaaaaaacggataaaactgaaaaagcaaacaaaaccccagctatctgacagtcaggaggaaaagaaggaccggcggatcccaactacccggtataacccggatcatcaaaccgggctgaccagccagcaggtacaggagcacagacttcacggctggaccaacaaagctgtggacccgccgtccaagaccacgaaagaaatcatacatgacaatatcttcacatattttaacttaattttcatagttctggcagtcctgctgtgtatcgtcggttctttccgggatctgacctttctcccggttatcattgccaatacactgatcggcatcatacaggaagtgcgggccaagcaggttctggacaatctgaccatgttaaacgcccccaatgcctctgtggtccggaacggcaaaacttccgtggtaaatgccgaggaattggttctggatgatatcgttatcttcaaggccggaaaccaggtctgcgcggacgctttagtcagcgccggggaagtccaggtcaatgaatccctgctcaccggtgaatcagacgagatcaccaagagaaaaggcgatcagcttatgtcaggcagcttcattgtgtcagggcagtgccatgcaaggctggacaaggtggggaaggattcctatatttcccgcctgactctggaggcaaaggaaatgcagagcggggaacagtccgagatgatccgctccctggataaactggtaaaattcgtggggatcgccattatccccattggccttatgttgttcatacaggcatttttcttccagcatgaggctttccgctccagtgttacctccatggtggccgctgtcatcggcatgattcccgaggggctgtacctccttgcaagcgtggctctggcggtaagctccatccgcctggcccagaaaaaagtcctgctgcacgatatgaaatgtatcgagacactggcaagggtcaatgttctctgtgtggataagaccggaaccatcacggaaaactccatggaagtccaggaggtcattgcaacagatgactacgattccgaagagatggaacctttatccgtgatgatcagcgatttcgccgcagctatgagcagtgacaacatcaccatggctgccatcaaaaaacattttaaaaccacctccaagaaaaaagcggtgggcaaaacagggttttcctctgcaaccaaatacagcagtgtgacttttgaggacgtgacctatgtactgggcgccccggaatttgtgctgaaagaggactatgatgactataaagatgagattttagaatatgcctccaaaggctcccgtgtcctggtattcggcacttatgatgaggagattgacgggaaagccctgcaaagccccattatccccttaggctatattctcctggcaaaccccatccgtgagcaggccaaggagacgtttacctactttgccgaacagggtgtggaggtgaaggtgatctccggcgataacccggctaccgtatcagaagtagcaaaacaggcaggcatcgccggagcagagaactatgtggatgcctccgacctggagacagatgcggaagtgagagaagctgttctgaacagcactgttttcggacgtgtcacgcccaatcagaagagacagtttgtacagatattaaaagaagccggcaagacggttgccatgacgggagacggtgtcaacgatgtgctggcactgaaggatgcggactgcagtattgccatggcctcaggcagcgacgcggcagcccaagcgtcccagcttgtactgctggaatctgatttttcctgtatgccccaggtagtgctggaaggacggcgggtggtaaacaatattcagcgttccgccagtctgttcctggtcaagaatattttttccttcctgctctccctgttctccgttgtatttatgctcacttatccgctggagccttcacaggtatccctgatcagcatgttcactattggcataccggcatttttcctggcactggagccaaataagaatatcatcaagggacattttctcaccaatgtatgcctaaaggccatgcctgctgcgctgacagatgttctggcggtaggagcgctggtggtgttcggaagaacctttggagttaattctacggatatctcaactgcagctaccatgctgctggccattgtgggatttatgatcctctacaagatcagcgcacctatgaacaagatccgtgtgggcattttgttgggaaccattgcgggactcatcttctgcagtctgtttttaaataacttatttgcccttactggcatgtccacgaaatgcattatgctctttgtagtatttgccatcgccacagaaccggtactcagatacctgaccatggccattgaaaaatgccgcaatttgtatctccgcttaagagaacacggcttaaatgaactataacaacaaaaggagcgcaggttaccgctgttttcagacggcagcctgcgctcctcctttttatttcttctcacccaaaacacgttccaggacttccgcagcctttttcactggtatgatctccagtttttccttcacttcctctgccacatcctccaggtcctccttattttcataagggataaacacttttttcactcctgctctctgagctgccattaatttctccggaaggccgccaatgggcataacgccgccgcggagagagacctctcctgtcatggcatattccggactgactgctttttctgtcaccagagaggagagagctgtcaccagagtgattcccgcagaggggccgtccttaggaaccgcacccgatggaacatgtatatggaggtccattttgtcaagtttttttgtctcctccgggtacatggcttttaccagtgtcagggcaatctcggcggattctttcatcacatcccccaattggcctgtgatcttcacctttccggttcccctgataagcgtagtctccacaaacaggatttcccctccggctctggtccaggccaggcctgtcacaactcccggcacagcctcctggagaatgccctcatgatgcatggcgtttcttcccaggaattcaggaacacgcttttcactgactgtgatgctcttctgctcgcccttgactagcttcactgctgcaaaacggcataggatatccatctgttttttcagacctcggactccggcctccgccgtataatcgctgatcatcttggtgatggcttcatctgtaaccttcaggttctgggctttgatccccatacttttcatagctttgggaagcaggtgttttctggcaatgtgcagcttttcgatgggcgtataacctgggaactggatcacttccatacggtttaacagtggttcgggtatggtatccgtactgttggcggtacatacaaaaaacacgtttgataaatcatagggcacattcatgtagtggtctgtaaagctgttgttctgctccgggtccagcacctccaaaagcgcgctggccgggtcaccgccgtaatcctttgccagtttgtccacctcatcaaggaccatgaccggattattcgctccgcttcgcttcatcccctccatgatccggccgggcatagcccccacgtacgtccttctgtgtcctctgatctccgcctcatcccggatcccgcccaggctgatcctcacatattccctgtgcagggcctttgcaatgctctgtccgatacttgtcttgccggtaccgggcgctcccacaaacaggagaatggaaccggactgttttttgttcagagccatgactgcaatctgctggatgatcctgtcttttacttttttcaggccgtaatgctcttcatccagaatgttttccgcctcctgcagatcgatctgcggtaactcctctgttttccaggaaagacttgtgacaaaatccaggtaatcatagagaagcccatattcatgactgtccttgccctcctgcctcatgcggtttaagaccttttcggcttctttttgcgcctcctcattcatgcctaactcttttaatttgttctcaaatcttcggacatcggagatattttcagggtgcatctcatctaactggttctgcagaaagtcaatctgttttttaatggcagactctctgtatgcctgttcatgagtctccttttgtgcgctctgagcctcctcactgaccttgaacagctcaataaattcatagatggctttctcgatcagttcacacctctgtctcctggtctctgcctccagaacagcatatttttccggccaagacaaattcagataaccagaaagagcgcagagtatctcattcatatttttccagtgcagaataaagcttcttgcccacacaccccattgaaacatctgtacaaacttcagcagatctcttttgagtgcttcaaaacgcttctgcatctcctcgtcggaaagatcctccacttcgccgcagatggccccgtcagcggatatggactgcagggtcacttccacatcggaaatcgccacacgctcttttgtatggacacggatattcccctcctcatccatgctctcgatcctgccggatacccccatgggacatatatcatccggtgttatatcctcccgtttcttgtcctgcttcaacatcaaaaacaggacatcctcgcccacatgttctgccgttatctcctgttctgtaaaaatatcttttttgaaaaagaaggtaacgtccggcagtatcgtcatatcgtaaataggtattgtgatcatatgtgcttcctcctcattttatcagcactcaatttagttgagtgctagtatcaaattaaaatatatagcgaattcattggaatccgccaagtattgtgatataattttaccattcaataattattttacaagtacgcagtattttcatacctagtatgttttttcatacctactgaaaacctgtagaaaggaaaccggttatgtattcatcatcaatggaaaaagaggaaaacaatgctgtctgcccgctgaaatatgccctgaatctggtaggcggtaaatggaagcttcctatcatctgcattctggcgcgggaaggatctgtgcgctataacagcctgaagcgaaagctctccgggatcaccaacatgatgctctcccagtccctgaaagaactggaggagaacggcatcgtccaccgggagcagtataatgagatcccgccccgggtggagtattccctcacaaaggaggggcgcagtatcctggaaccgctggacagcctgtccgaatggggaaagacccatatggaaaaaatgcagacgcactccccctactgccgggagtgcggggagatgaaataggctgccctgtcatctgcctgttcaaaggatgcctgttctgaaatgatatcaaagatcaggctgccgcccagccagaattcgtatcggacccggcaggaaggactttctctgatggtgcggctcatcacaccgcactttggtgccttcaggtcatgggacgcttcttccagtctgcgcactctaagccgcatctttccctgcctgatggtcacttttccgtctccatattcctctatgcggactcctaggtaggtagccattctgtactctctgcttccacagtgtacagcgcagatgcacccctgaaaatgagcacctaaaaagggaatgtccgcaacagacagcatcacactgctgcgtctgccgaatccgcactgggtccagagatatgtctttggaaaggagcgccctttatctgtctcaatataacctcttcctcctgtcatgggaatttctctgccgtttaccaaaagacttcctttcaggctgtggtgcatactcagcacgccgtgcctgcactgcaaaaaggggatatatttgaaaaatcccataatatcatatgacaatctgtcaaaaggcgcataggctatacagccttttacagtcagttccctgctctctatatcaatctgtattcccttatccgtaaaaacgttttttcccaccctgacgccgaaaggcttcctgctgatgcggcaggcttccttcggataagtgaaataccaggcgccttcctcagtgaccacctgcagggataccgtccactgtccgtttttatctgcatggacagccgggataaacgcaatggtattgtcctgattctgatgtttcagataccatccctcaaagtaagggaacaaaaatgccgcacatcctctctgaatacatgtctctttcatgttcttcacctctatgtctaaaattatctgcagcttgcttccgcttttcagacatatttaggatgtacagcatttataaacggtatacgttatttcattcaggcatttttctgttcctcgattttttctgccagatcgtttaaatagacccagcgttccatcttctcttccagttctgcctctgccttttccttctcggcagtgatctcagacaattttaaagagttggtggcattggccatcatatcctggtccagtttttctattttttcctccagagccgcgatctcgtcatcaatcgtatcatactctctttgttccttgaacgtaaatttcagctttgccggacggttctgtttccaatccttgactgcttccttcttttccggagtctcttttttctgggaaacgctgatgtcagcccctttcagacgtctctccttagcctccagataatctgtgtagccgccctcatactgctgcagatgtccgctgccgtcaaattcaaatatcctgtccacaacattgtccagaaaataccggtcatgggatacagtgatcacaataccggaaaaggaattcagataatcctccaaaattgtgagagtggggatgtccacattgttggagggctcatccagaatatatacattggccccgctcacaagcacggagagcatgtacagccttctcttctctccgccggataatttgcacacaggcgtatactgcatgtccggagtgaataaaaaccgctccaacatctgagaggcactgatcttcccgtctctggtctggatgtattcagcaatatctttgatataatcgatcacccgctggttcgtatccagatccggctcttcctgtgccagatatccgatcttgatggtttcacccacctcaatctcaccggaatccggctgtatcagtcccgcgatcattttgatcagagtggattttccgcagccgtttggaccaatgatcccaagtctctggtttctaagcacaatatagtcaaaatcatccaccagcttcgtctcaccatagcttttgctcacatggtgcagctcaatggtcttctttcccatccttgtctccacggaatccatctccacagtctgatcctgtaccggagcctttccgcttttcagggcttccaggcgttccagtctagctctctgcttcgtgcttctggcccggcagccccgcttggcccactccagctccatgcgcaggacactctgcctttttcgctcagaggccagttccatctcctcccgctctgctttcagctccaggaatttggaataattggcatcataactgtacatatttccccggctgatctccaggatcctgttggatacccggtccagaaagtaccggtcatgggtcaccataaggatcacacctctgtattccctcagatactcttccagccaggtgatcatttcctcgtccagatgattggtaggctcatccaacagcagaacatcaaaatccgaggccagaacctttgccatagccactttccttctctgtcctcccgacaactggtcaagcggcgtgtcatactgcacgatcccaagctttgtcaggttgctctccaccatccagtccgtctccgccgactttcccagggcataggaggatacggttgcatcccggggaaattcgggattctgaggcagatacgcaatgcgcagtccattctgcctgacgatctgtcccgcatccggttcctcaatccccgcaaccattctgagcagggtggtctttcccgtgccgttgataccgattatccctattttatcaccttcgtggataccgaaagaagcatcctcaaagattgtcttttctccgtatattttgctgatatgttctatatttaatatgttcatttgtgacgctcctcttattctcatactgacaatactcatcataaatgattttgaacggaacgtcaacttttatcctgatgcttcaacttggagcataccgtttcaggacagccttccattatccatcgtatacacaatatcggccagattcatagtggacttcctgtgggatacaagaatcacggtctttttatgacaggagtccttcagggacttcaatatgatgccttcattcaaagaatccagattactggttggttcatccagaagaagaaatggcgcatcgtgaagaaaagccctggcaattccaatcctctggcgttctccccccgaaagggtgtcccccagttcccccacctccgtatcatatccttttggcagagtcatgataaaatcgtggatggaagctttttttgccgcttccatgatctcttccctgtccgcatccggctttccaaccgcaatgttgttggcgatggaatcgtggaacaaataagtctcctgggtaacatatgattccatccgccgcagattttccgtgttgattttctttatatccctgtcggagatttttatacttccgtcctgcgtatcccagaatctcatgaggagctttaagagcgtagattttccggagccgctggcaccatgtatccccacgatctgccccggtttaaaacaaatggaataatccctgagaatcgtctcctcctcataagaaaagttcacatgttcacaggatgcaccggtaaatcctgtctctttttcagcgctcacttcctgtaccattggttcctcctccagaatggaaagcacccgctccccgctggcaagtgtctggttcagattattggaaagactggataatgccaccacaggtccaaaagaacccatcatggaaaccgtacacaaaagcacctctgaaaagccagcctgtcctccctgatacagatacagcatgagaaacagcatcaaaaaggaaaataccaggatgctcagattggtgatgcccctggcggacgcctccattttgcttaaatccttctggataccgccaagttttacagagcgctcattcatctgctctttcctcttctgtccctgtccgtactgaatggtctcatccaatccccgcagggaatccagcacaaagctgttcagttccccaaagccggttctaaattccatgcctttacttccgcctcgttttccattccagacaggaagtacgacacccaccaccaagtatcccgcaagagccagcactcctgcatataaatgaaaatgccctataaacagcaccatcaccagagatgtcagggaacctatggcaatgggtgagatcgtatgtgcataaaacacttccaaaagctcaatgtccgtagttataatggagatcaggttccccttgtctcttccctccaattttgccggacatagcctgcgcagggacgcaaacactctgtgccggataatagccagcaatttgaatgcaatataatggttacagtattgttccgcgtaatgcagcacgccccgaagaactgccataatacccataactgtaaaaacagttccaaagggcagagaaattaaaaatcccggctgttctgtcagacggattccccctgcaccaaccatagttaatccgtgcaaaatggcgcatccggccagtatagtcagaaaaatagcacacaggtagccgaggactcccagggtaactgccgcaaacattcgtcccataagaggtctgactaaaccaatcagacttcccataatgcgtattccgcttcttctctctttcatcctctcgccccctctttgtctgctgcatgactatactgttccaaagcgctctggctctcaaaaagttttctgtagcttccgcactgtcccatcagttccccgtgggttcctgtctcagcaattcttccgttctccatcatatagatacagtctgcccccactccattggcaagtctgtgggaaataagaatcacggttttctctttagccatctgccgaataacgcccatgatcatctcttcactctccacatcaatattggatgcggcttcgtcaaaaatgtacaccggcgtatcgtgaagcagcgcccttgcaagggcaagcctctgacattgtccgcctgaaaaattgcttcctttttctagtacctttgtatccaaaccgtcctgttcttttaagaacgcaagcagattcacttttgagagtgcttcctccagctctgccctggtggcatccggcctgcccatccgcagattgtcctccacggtccctttaaacagatagctgttatggcttaccagtgtcaccgtctccatgagattttcctcatccatttgggaaagttctttctcgcctatgcgtatgctcccttggtaccctttattgcgccccatcagaagggatacaatggtactctttccacaaccggaggtgcctgccagagaaaccatacttccggcaggaatatgcagagacacatcctccaatatccccctgtcctcctcataagaaaacttcacatgggacagatccaccgacagatcacttttttcggctctcccggttcctctttccggttccggtgtgtccagcagagcaaaaatcttatcgctggctgccatgccgttcatcgcaatatgaaaaaatgaccccaacagcctaagcggaataaaaaactcagatgccagcagcacaatggccagcgttcccgcaagggatacatttccggcaagatactcccgtacagccacgatcatgccaatggcagcaccgccgtaagccacaatatccatcacactggtggagttaagctgcatagtaagaaccttcatggtaatattgcggaactgctctgcctcccgatccatctcctctgccttcttttcatccgccctataaatctttaaggttgtaagcccttggagattctccaaaaagctgtccccaaggccggcataaataccccagtatttattcaaaagccttttggcaaacttctggaccagtacaatggatatgggaatcagcgggacacaaagaagcagcaccacacttgccttaatatccacaaaagccagcactgcaaacaaagtcaccggtgccagcaggctgtagaataactgcggaagatattttccaaaataaatctcaagctgctccactccctctgcggccatctgtaccacagaagaggtggctgtatgctccctgtaggaagcccccaggcgcagcagcttttcataaatcttttctctcagaatccgttttacatccacacttgcgtgataggatgccctggaggacatcctgtcacataggaagcgcataattacagcagtcccaaagacaaggactgtctctccacagtctctggcagtcatggctctgtataatgccttttccagcagtcctgtcacagagaatatggcggctatccaaaatagcagcgcaatccactgccacagaatattataaacaatatacttctttccgtgggcaagaagcttaaccagtcgtgtcttaatcatattctttttccccttccggaatggtcctaatacagaaagcaaaataaagtacatggcatacccatacggcagccagacagatccttcccacaggaacacggctcatcatgataaatcctactgacataacaatggtcacggtacccatgatggtcagcttacttcgcagtgtcatagatttgcttttcacaaagctttccagatgcttcttgtataatcctgtgcccataaaccagttgtgcagtttttctgagctttttgcaaaacagaataatgtcagcatgtaaaaaggcactgtgggcagaatcggaagcaccacaccgatggtccctaacgccaggctgataaatcccaatatgatccatagtatcctgaatggatttttcttcataatcgtacactctcctaaattgtcaggacaaatttctgcccttctatttttgttacatccagacggattccatagagggtctcaatactctctgttgtgatcacgtcgtttggtttccccaggatttccacaagcccacctttcagaccaatcactttgtcagaaaaatatatggcctgattgatgtcatgaagcaccatgatgatcgttatcccaaattcccggttcaatttttttatcagctccaggatttccacctgataacggatatccagatatgtagtgggttcgtccagaaacaatatttttgtattctgggcaagggccatggcgatccacaccctctgccgctgaccgcctgagagcttccccacctcccggtcccggtattttgttatattcgtcacctccatggcccactctaccagccggtcatcctcctcgcctttggcctgcatcattttcatgtgaggagtccttccgtatgacaccaggcgttccactgtaatatcatcactggaggtattatactggtgtacaatagacaccttctttgcaaaatccttcagccccagattctgtatattctttcctcccaaaaagattttcccctttcttggatacaggttcttagtcatgagggaaaacaaggtggatttgccgcagccgttggctcccattatggttgtgatctccccttccccaatagcaaaggacacatctcttaaaatcttgttcttaccataagaaaaggagagattcttaacctccattgctgttttagtttgcatatttctttgacctcctcagcagaataataaagaatggcccgcccacaacacacatgataatggatgccgaaatctcatagggcgaagcaacggttctccctatggtatccgccagcaggaaagtaaacgcccctaaaagcatggaaaacggtatcaatgccttgtggtcacttcccaccagtatccttccgatatggggaacgatcaagcccaaaaagctgatagcccccgcaacggctgtggagatactggcaagcagtacagctacaagagagatcgtgatacgcatagtgtttacattgacccccagccctcttgccgttttatcctccagggacatcaggttgcattttccggaaaagattatggccaggatcaggcctgctatcacataaggaaccagggtttttacgtcatcccaggttttcatggtaatatttccattgacaatagacgcaacccctgacatattgcccccgctcatggaatttagcccgctggacaaacctgtgaacatggaatttacagccacacctacaaggatgatccgaaggggacttaatccccctttccaggaaaggctgtataccaggaaaaacgcgaccacacctcctaaaaacgcaaacagcggcgtgaagaaaaacagggcaggcgcaaatgcagtgatcatgaccgccgcgaagctggccccgctggaaataccaatgattcccgggtcagccaggggatttttcagcactgcctggaataatacgcccgatacggcaattgccgcccctgccagcatggaaataataatacgcgggaatctcaaatcgtaaatagttgacacatcatcattaaattccacaaacaagcctctgagcagttctccaaagctcaccttgagacttccgatattgaccgctgcaaaaaacagtatgagcaaaagcaatgctatcacaagaaaagacgcagcagtcctggccgtcttcttcttttttctgctcttatctatttcttccagggagggggcagtctcctgcaccattcctgatctctccggtgtttccattttcatccctcctacttggcagcctctttcaaggttttatcgtctgtcttttctgtggcctcggagtcttcagccgcttttatggctttctcgctgttttcttttgccttctctatatcctcatcgctgtcgggatacagcatgggctgcagttcatctaatgcttccggataacggaaggtagcactcataccaaacaattcataggtcaggtcataaactctcccgtctttgactgcgtcaaaatgtttccagatatcattcgtctcaaaatcatctttgaacatggataccacctggtccggcagcgcatgcgctgcccggaggatcacatccggttccttggttttcatatcttctgtgttcacggtaaggaattcctggtctgtacctgcatagacattctcgcccccggccagttcaaccaggctccccacataggaattttccgtggcaattatgtaagaaccgggcagccccatgagtatcaggactttaggtttttctttgtctttgttcttatccttgtattccttgtaaaactccgtaaactctgccacctctgcctctgcttcttcttctcttccgaaaatctcacccagctcctgtatggaacggtacatccccggtacactccgcagatttaaaaatgcccagtctgtgtcaatggcttcatattttggctgcagatccgactgcaggcttgccggacttaaaatccagtccgggttcagggaggatacaatttccatatccggcgccattgcggtgcccacctgttcgatatcctcatagcgttcaggcaaagtggagatggttgtcttacagattcctaccaaatccaggttcaggcggtcacagatatctgcggttgccggagatgtggcaatgatcctgggctcctcctccatggcggccacttttttcttggctgcctccacggcggctttttcctccggatcgtcaatttttaagagcatttccacactgtcatcctctgcggatactgccgcaccggtactctggctttccttctcactttgattctggtccacgcatcctcccagaaccgatgctgccaaaagtaaaccaaggaccgttcctgccatctttccatacatacaaaatttcttattcatcatcgtcatcaccactgccccatctataccagtttttgcggaacagatatactacacctgccacagctcccagtaagatcaatcctgatatggtgatggaaaccaccagaaccagaatctgttttcccgctgaaccgctttcgggggataaggtctctgtgcctgctgccaccgcttcacctgcagtggaaaggcttaatccccgggcactgttaagcgtactgttttcagtggaaggtgtctctgtgtcttcagaaggagctgccgcttctttaatactgctctccagtttggatgcctctccggtggaattctctgtattctctgtatcctctgtattatccttatttacggatgtatcatcattgtctgaggatgccggctggctctgtaaagctgaagcagagggagtgggttcagactggtcattttccgagccggacgtgttgtctgtccctgccgtattgtctgtatttcctgacgtttggctgcctgatgctgccgtgtcacttcccgatgctgatgtgaccatggtggcattcatatctgtattattgccctccgcataatcacttggatacagatagaaaatcacatccctgcccattggttccacatacatagaagctctgaccacacaattttcacttggtacctggatgcagatatcattcgtcgctccattattgtctgtaccattccctgtaacacccatagccgggctggaccagccggagtcacctacattctgcacccaaaagctgtgtcctgatgtgtagctcataaggctcatgcgtatggtcaggtagtattccccgctgtctgtcacctccagtatcccggatgtgtaaacagccccatcaaccatcccctgccctgtggcataagatgcctctccgcctgaatcctcaatttctcctgttaccgggtgtgcataacagggatggatgacacaggtataaactgtgcctgaagctgcataaaccggaacagcagcaatgcctgcccccataaagagggcaagcatcatgcttaaaaatccggcaagaaacttattttttattttcagtgccttcatcttatttcctttctgtgttttggcattttttctcctggcgtttcccatatactgcaaggcttcccatacaaagggcaagtaaagccaggaataccagtccgctgatcggtgcttcatcaccggtcttggcattggatgccttcagagtggaacctgtgctgttggaagcactgcttagactgcttccgctttttaaaccagagccgctgcttgtcaggctggagccgcttcctagtgtggagccgcttcctagtgtggagccgcttcccagagaagaattattattgttgttgtccgtaaaatcaggatcatctgccgttgtggatttcagggtactccaatccagctttaagaacacaggctgtgttccggttccagcagagatagattccataatcggaacaaatacctgaagaggtacatacccattctccagtgcttccggaatcagctcaaaagtcacctgatccggataatttgttccgaagctatcgcttatcagacttccgtcactgttcttctggtaagcatccacagttacgtctgccagtgttcccaccggatttccatactgatccagtgtataaccggtcagataatatttaagctggctcaaataaccaaactggctgctgatggcaagtcccttgaagtcaagggtaatataatacttgccgtccttcacagtcagcttgactgtgtgattgatggcttcattggacatggatgctgtagttttatcaatctttaccatactgccggtaatagaatacacaccgtcggcaagatttttgatatcaaggttattattattgttgttgttattattgttattattgttattattgttgttattgttatccccgtcatcattgttatttcctgaaggcgcggctttcagatcgagtattgcaagggcaagagccgaggcctgtgcgtttacctcctcctgtgtggcatcctcattattgaaaacagtctctgcggctttgataactttcttcagggctttaatggagtcttctgtgtacaggttatctctccctgccatattggatgcagtcatcagcatctcatgcaggccctgcttctctactttagccggttccaatttttccagattattgactgcatatgcaaggattcttacctgtgcgtcaacttcctcctgagaggcattatcatccttgtaaaccgcgtttgcagtatcatacagggattgcaaaacttctatggctgcagccgaatagttttcagtgtcctccagatactcttttgcctctgtcaaagctgtttttagttctgttttcacagctcctaccgtctgaagaccccgaattgccttgtcaacggcctgtacacatctgttgatctgggtctgggtagctttttcattctggtatgcttcccatgcctgatctcttgcctgctgcaggattgcctttgttgtggcagtataagttacgtcttctgcatttaaataggtatctgccacttcaatcgctttcttcagttcggacttgtctgtcttaacctcctcctgattaaacagtgtttttgttgtattcagggcttttgtcatagcatccacagcttcctggcccacattcacattatcctgtacaaattttccggcttcgatcgccttatcaagaagattcagtttttcctgtgtaaagtctgcggctgacaggacagttttctgtgcatccgcctggtctgtgttctctgtctctgcctgtttcattttctctgctgccgcgtaaagctccgccttcaaggtctccagggatttgatggctgtatccagctttgtcttatctgtctgtgtccctccggtctggctcagcgtactccagtcaatctgaagcttcgcgtactgaagaccgctgcctgtgttgatggcttccattacaggtacatacacctgtacccatacttccccatcccccaggtccaccggcatggtcatatagtgggggtacaactgccctttcacattctcatcggttccattgtccggatcattgtatgtgtcatatacgccttcaaaatactcttccacatccagcgaaatcggtgtttcatcggttggcatctgatagccgctttctccgccttcccatcccgggaaatagttcagttttgccaggtacccggtaaatccggatgtggtcaacgggccaaattccattctcaaggtggctttgccgtccttcacgatcacctgcattggctttctgagagctgcgttccccatggatgcctggtttgctgctgcatgccagattcttccgtctatagtataagttccgtcatataccacattttcttcttccttctggaccatggaagccgacgcatctttcaggagctgcagatgcttgtccacctcagtctgggtggctcctgtatcattgtatactgccttcgcagactggatagatgctttaaaaaattcaaccgtcttatctgcatatgggctggtatccagtttttctgcctgttctaccaggtcctttaactggcttttgtcaacagcgccatataaattttctacagcagcctccagagatgcggtttgttcatctgcctgtgcctgggatgcgttttcatcgtctaagaccgtttttgcattcaccagggctgtctgcaggttatcccaacccggataatcgttattcgttatcgctgctgctgtgtcatatgccgcctgaagtgctgtcttgtcagccctgacaataaggccctctactgctgcctgcagtttcatgagctgcgcttccacatcctgcccagatgtattgggatcctcaagaagggcttttgcattctggatttctcctctcagcttctctagagaggcaggtgtgtatttttcggcatctgccaataccgcctctgcggaggtgacagcttctttcaaagcatccagatttacgtcttttatcaatgcgctgatagccgtattcactttttccgtctgatcatccgcctctgtctgcagagcgaaggggtcttgggctgtctgtgctgccattgccactgctttctgaagttctgccaccgcatctgcctgatatttatccggattttcagcagcttccttcagcttttcattggcctggtttaaggtttctgtcagtgcgtccttgtttactgtctgttcagcaaaatctgaaaacttaagagctgtctgcacttcttttccttggatgtctacatattttatagaaacagagtttgacatggtgccaagtgtaaatactgcccctgtaactgtttccttgccgtcatcacctgttgttttttccatttcagcatccacatactgtttttctgcaaggtcataatactgaaaactttgaattccctgtacaccaagagagatatccgcgccttcctctttcacaagtatcctggtatccgtcacaatatctgtgtcggttatggatcctaatgctgtgtacaacccctgattcagaatgacatcatctggggatttcaggttgttgacagcttccataagagcggtgtatgcacgttccatagattcggctgtttccgtttgatatgcttcttcggctgcggcataagcagtctcaagagcttcccaggtttcctgtgtatattcttccctcaccgctgtttcagctatggtgatcgcctggccaagtgcttcttttaccggttcatccggcgtgtcattggaaatcttttctgcattttcccaatccagagtcagccatgcatcctgtgggaagtctccgccgccgatttcatccatgataggtaccttgaacctggcaggccattttgccgtatcactcaccaacttcacatatcctgatttaggataatagttgagagtaccctcgttggcaaagtccataaaaaagcttccgtccagattcttgtagtaggagtaaaaagtaaccggtatcagcgttcctgtgggataagcacccaccatggtcatgtcttctccgtaaagccacatttttgtcatgtatgaagtcatatcaagataggtgaccgttgtataatccaggtacaggatcttctcatctcccttgacaaccagtctggcattattgtcaacacactgattcgccatggaattggcgccctcatttgtcaggtgcatgatagaaagaggaatcgtgtaggtaccatcttccatctctcccgcatcctggctgtccttcacttcatacaaagcataataacccaactcttgtgttttaatgacaaaataatttccgctgtccgttttttctatggttcccttcaaatcaagagatattatcatgttttcatccacattgactaatttcacattgtccaggttccagctatccggtattttgaatttaagctgtaccgtactggtggttcgccttgtctccctaccatcctggaactgtatcttccagttatacatatacatatcagaatatgatatgttgttcatgatctgagaataggcgtccacgttatcattcggatcatctacgatttcttccgcaagcaattggctgctgtcaggcaatacaaaagaatccgtgacaagaagggttcctgtcttatcgtcttttagttgaaccgttgacgcaccattaagctcagggataatacaagtatcataaaaacctattcctccaccggcaaatttccggtaaataacaatcgactttccgaaaacaaaatcattataatcatttaattcatacaccaactctaattttccggtgctgatatctatatcattaccgtccgcatccctgatcacagcctgatcctcgtccagcaaatccagattaagtgaaaaaacgcctgtagctgtatctccatcaatattccactcagcggttgtatccagaaaatatttttggcaatcagcgccgcttgcggcataaactgctctaaacccaatttccgtaatatcctgaaattcatccagatttattttcacagatgtctgtacattaagtgcagtatcgctacgactcactcttttgccatcaccaagttttagaagttgtgtgatattaaatggatcgtccagattttcaacctggaatgtcagatatacccattcgtccttatcttcccgtgtatagtcaaaccagtatttattattttcttctaccgctccatcttttatttcctgtgaaaactgggaattctgcaggtcaaaatcatctgcccagccttttgtccccgtcagacagtaatctgacaagtcataattataatattcctgcttcatgatccctaagaacgcgccctcatccactgtcgctttagccaactgcaaagtgacttcgtagttgctattctcagcctttatcaaagctcttgcacttctcatagacctacccggctcattttctgtgagcggcaccgtataatatccgtcttctaattgggtgtgattctttgcgtcatcttcctttttcaccaagctgtccattgctttttgaagtgaattcagaagcattttctggtattgctccggaatctcctccggttctgtgatgctgttcctcacctcaaggaatgcattccaactttcccttgtatactctgattcctccagactgtctgcttttgccagcaatgcaatgagtttctctaaagtagtctcatttttcacaagtctatccatggcttcctgcagtgcgtttatcactgtgtcaaggaactgctccggtatctcctccggctctgtgatggtgtccctctggtctttgaacgcctcccagctctccggggtgtagtctgattcctttaatctgtccgcctcttccagtaaggcaagcagtttgtccagcttgctctcctgtttcacaagtccatccatggcttcctgcagtgtgtttatcactgtgtcaaggaactgctccggaatctcctccggctctgtgatggtatccctctggtctttgaatgcctcccagctctccggcgtgtagtctgattcctttaagctgtccgcctcttccagtaaggacagaagcttatctaataaagtggaacttgatttctgagcagtttgttttgtatttggtgtattatttgaagccgcatatgaagcattcgtcaaattggacatcaatagacaaaccatcatgattgcacagactattttatagatcttacttttcattccatccctcatactttacctccaacgtcagtaagagaggcataccaacatctggtatgcctccccctgcgaatttcttttatattattccgtcacaactgtggggaaaataatgaaatcaccttcggatgccggcatgattgaaacatttgttttaaaacttgcatcatactttgtcgcttctgtcggaacagtgggagagttaaaagtaacacctacaactgcttttcctgactcgttatatgtaagcttatattcttctgcatcatattgtccatcaccattggcatctatctgcacattggtgagatatcctgtcatgccataagctttaaatgattccttcagattaatagtcactttatatgtaccatccgcctgctcaacatatgtagtattctctaccgcagcatctcccatagacagattgctgtccggtgcacttgcatagaatttgtcatttttatacagttttgtaacaagtgtagtgctgtccccttcagccgcaaatgttgtaacccccattgccatcatcatagttgctgctgtaccaaatgctactaatttcttaaacatatcttccatcctttctgccttaacggctataaaactttaatattttagggcgttcttacgatgatagctatagttagtataaactaacgcttattcttaaaaaaaagcagtccttgcccgcctgtcaaaagcatatgatttttagcttcatcgtatagttagtttcaactatcccgtgctaaatatatagcatatattggcaaatactgtcaactgatttttttaaaaccgttcccgtcctgcacggttttttccctataagtacaagtgtttttgtttctttttcgtctctaaaaaaatttcaaattttaattattcttatatctatccggttacatccaaaaaaacaaaagtgccgtactctccggcatatgggttctgcctacattgcaggtcaccgttaccggaatcacgcctttgattctgccctcgcgttttctctggaagcggcatgcgtccagtggaattctcagcttatcttcctttacttctgcctgacacaacatacctttgtactcatatttcagtgtttccagatgccccagcttttcttcaccatctgcccgtgatctggcactcatttcacacactcgaagttccagccagctccctctcttgttatgccgtatggttgccggtttttgaaaacctctgtctgccatggatatactgatcttatcctcagaatcccttttataaagtgcaaagcatacatgccacattccgttttcaaaggtactggccagaaaatttttagatactgctcctcttttttcagcaatatacatccgtctcatctcctgatcattccgcatcattgacatcaatgtatggtaactcacattttctatcagattccttacattctcagcaacttccgcttccggttctcctatgcgcagtaaatagccctttaattcctctataagctttttataccccccaagccacgcttttcctaatttagtaaactcataatcttctgtcaaataccctttctcacagcagaactgcagataacggctgaccggactgtggctgaccccgcaggtttttgcgatctgcatgacgcaccctctttttttgtcaattttctccagttccaaaagatactgaagctgctgtatattcggacggttttcctgattcagatgctcttcttttcccattcccaaattttctctcctttaccagatatgtacatttaattcccgaatatcctcttcttttggcggctgtatcctgggtggaaaagcaatcatacagctcccttctgtcaccggatcatccgtgcagacggtaaatataaaaatatctgaggggatttgataaccttctttcgtttcttctgcctgcttccattcctcttcatccctgtaccagatactgtcgatactgtccatctctgcttcgtccttttttctcagataaaaataactttctgcactttttacatttaaagcaatctcatcggaaaacaaaaaaaactcttttgccaaaatccttggatatctcttctctgtataatagatacccatataaaactcataccatccttccctgtacatagaataaagattggcattacgcatgacacgatcataagtgtctccataattcaaaaaattacatattttctttgtagcctcatcactcagcacgtgttccatacggcaggcatcctcctctgcctgcttctcttccattccgataagctggaaaaactgtgcaagacgttcatggcggaaccggcactgtgctccctgggattttccaaattcagttagtttaagcttctctctgttatccaggttatagagataaccatgctttaccatctgctttagatagtaattcagctcccgctttgccatatcaagcttactgcacagctccgagctcgtgggttgggttccatttttctgccattcgtagagtatttcaaggagatcctcctcccgctcccctttagaagatgggaaattttgtccgatttctccgtgaaaaatatctttgacacattcagttttcatacacttctctacctctccagtatttctttatttggttagcctttgctaacttcaatcttttaaagaaagaatccggaatgccggattctttactctggtctggatttattataaaaaagattttattcctttgtcaatgcttattttctgactcatatgcattcaaaatctgtgaactgctgtaatcagggtatttatcctgcagttctgcaactgttttaacaaattcctcctccacatcgagccaatgacagatggttatcactgtaagtctctttctcagcattttacgtataatattgacctcctcctccctttttccctctatttttccttctgactttccttcctcttttaattcttccaatgctctgcacacagtgatctcctccttataatattttcgtttcatgtcgtttcccagcattgtaagcaaagctctgctggcttttgcagacagaccctccagttctctttcatgatttttaatatactgtataagatcctttttatggtttccacagctcaatgtttccaatatcagcctccagtcaccgggaaatttacccgggtctgtgttcttgggatcaaccaaatgtactttatacctgggaagatactcttttaactctgccgcatcatccggcaggcagatcatctcttccagggagagcggaccgtcccagggactgtctccataataaaaaacaacacttaccaccggcgtgagctgttcccctttatgaataccggacagaaactccgctgatgatttcagatttttggcttttttattgtcttttcgttttttcttcagttggtcaccgtattggacagaatcatataacaacatacgtaccggcattccataatgtacctcactctggttttcacagatgaaaactgcatacatagtattaaaatatgcctgcttcaccgtgtcccttaccagagtgtaagtcctttgatcttgtctcccctccccttcccagggaagctgcatgatcaattctctcggaagctgttctaaatgctccggccgcaatatctgtttccctccgaaaacagccccattcataaagtcacagaacacgttagggtcctcaaaaaatggcgtaataatatcatcttttactcccatttctcctccttatttacttttgatccactggaaatcttctggccgaacggccggaatagataaatatgaatactgcatgatgcagtgatctgttgtttccagaatatcatgaagaagaaaaaagggcaaatgaattttccataaaatttgataagaatatataaaagcgttacggttcgctctgaccagccgcccgctttaccgcacactgctattgaacatccgttccatgatgggccggcagctctcaagtttctcatattctgtataaagacatctcttgggataccaacatgtgacaaaaaatataaaatcatgtatctattctttaatatcagtatataatgcaattttaaattttgcaataccatacttaaattatattttatctgtaaacccgggtcccgctgttccccctttatataaattacagcaaataaaaagccaggagtacccatcccggcagggagcgtactcctgattcttatgcaggatactgattcttttgtttggttcacagcccaaaatccttaaataccctgatttaataggcaagaatcctggccggattatttacagtcatgttacggacagccagatcagagacctccccgtatttcttcagtgcaggaactccgaattttgtcagtctgcagtacccctctcctccaaactgtctgcacatggtcttcacacacatgtccgtgccaagtacaatctgacggctgtatccctgctggatgaggcgtacaatgcctgccatcttcatccaatccggaatcggcgcagtccccaatgcttccaggccaatatcaccggataaaaattctacagaaaagtttgctcctttatccagcaccctttttgccacatccaagtccagtccccatttttccgggtagaggaccatttccttcatgggtctttttacggttgtttccatgtgggcgatcacgatcttctccggatccacaccttcctccacgagtatctccacaatttcacccggagtaccaccgtaggcatagtccgggtgtaccgtaatggacatacctgtgtcttttgcggcctgtccgcctgcccggagagctttttcctccgcctctgtaaaatcattgagtgcaattttcacacaacccggctttatctgtgtatcctcgattccgttttcgatttcatctatcatatggtcgtagaactgccggatactccagccgtcatattttcccgaccaggaggactccacataatagccagttgctgtaataacattgactcctgtcttttgtgaaatacgcttcactgcctttacatccaggcggattcccgggacactcagctccaccatggaatctccgccggaatctttatactcctgtacctccctggtcatggcttcctcatcgttcagatccatggcatctgctacaagcggaaagtttctcttcaaaaaaccgatattctccagcgaaaccttatcctcatattttaccggcaggtccgtgggcatggccggtctgcagattgcccccatatccgcgccattgaacataatatgttcatgcatatccgtaaatcccaggttctccggagcaatatcctcgcacacggtcgttattcttttcataaacgcaaaatcctcccatcttccggccgggcagtcgttctttcttcctccgccgaagcaaattttcaaatgcactctatcactgcatccagcccagaaataccttttctatctgtttccttttccctgtcagggacccctggaccatgggcggctttcctccgccttttccgctgcagacctgatttatttcctttgcaagagcagtgatgtttctccccgtgctgcccaggacataacggtatcccgccttatcactgcccacaaaaacaccacagatcccctcagtgatctccatggcatcattgacaaatcggcgcatggcagccgggtccagttcctcctcgaacaaaaatacagccggcgtgtccggtgtaacctcgcacaaacgcagtttcagatattgttcctgaagacgcttgatcttttctttctgttcagcgatctctgtctccagcctgcagacagcctgcacaatatcctcctgctttgcggaaagtctgcctgatatggctgtcacactctcctcttttctgttgtagtccttaagcgcccggaaaccacagagcatgttcacccgcattccgcctttatagtggatggcaccggtcagcttaatgattccaatggcccctgttgtcctcacatgaggcgcgcagcaggcacaggtatcataccctggaatacggacaatgcgtacctgcccttctatctcaattttactccggtacgtaatcgtatccaactccgtctgggtcggatacaggacttctataggtatatcctcagccaccgcctgattggcttcctgttctatcatacggagctgctcttttgtgagaggaccgtcataatccatggtcacagcttcgtttcccagatgaaatcccacattccggtaaccgaaatgccggtttacaattccagacacaatgtgctcccctgtatgctgctgcatttttgaaaaacgctcctcaaaatccaatacaccggtgacagcagttttcggctgtgccggtctgtccgtgcagtgaaagacaacgccttgcctctctctcacatccagaactcggatctctgtatccggcagacgcagtacaccggtatccgcatactgtcctcccccctcggggaaaaaggcggttctgtcaagaaccacctcatagtttattcccgtatttatatcgttttcctcagacagagggctgcatgaaagcacctctgcctgaaaattctttatcatactgtctctgtaaaataatttttcagtcatggtcagtctccatacacgcggatcagggctgaaactttatgtaccacactcatgccttcaattatcatcatggcatcgttgaaattgccttcccgcacttttgaggtgacgaccacgatctcagccagatccccgtctttatttttctgtatcatctgcgcaatactcacatcattattgcctaatacactggcgatactggccagcacaccgggtctgtcatccacctgcaggcgcaggaagaaacggctgtccatatcgtctgccttctttacaggaagctctttatagcaggtgcagcttatccttccggtacagccgaaccggatattccttacaatatcaaaaacatcacctacaatagcactggctgtaggcatctcaccggcaccacgcccgtagaacatggtatctcccactgcgtctcctctcacgaaaaccgcattaaaggaatcattcacagaagccaggggatgactctcggaaatgagcattggctgaacccgaacttcaattcctgtctctgtgttcctggcaaggcccagcagtttgatcagacatcccagctctttcgcataccggatatccttagcggaaatatgcgttatgccctctgtggtcacatcgtcaaaggtcaccctggaattaaaggcaatggaggccatgatcgccatcttgcgccctgcgtcatatcctctgatgtccgctgtgggatctgcctccgcatatcccagctctgtggcaagtgccagggcttcggaaaattccataccctcctgtgtcatctttgtcagaataaaatttgtagtgccgtttactattccgataacctcctgaatatggtttccggccaggcattgtttcaaaggccggatgatagggatacctccggccacggctgcctcaaaaaggaagtcacactggtgctctgccgcgcagtctaaaagctctccgccgttggaggccaccagatctttgttggccgtcaccacgtgcttgcccgcgcgcagtgcctccaggatataggtcctggctggctcaaacccgcccataacctcaatgacgatctcaatagaggggtcttccagaatggacttccagtcattggtaagcagggacggattttccaccttggcagcagctttctttaagttgcggaccaggattttctccacctgcaccacggctccgatttttttctccatctcttctctttggctgttcagaactttatatacaccgtttcccacggttccaagccccagcagggcagcttttatcactttttcactcataattattcttctccgtcctccggctcctcctttttgggcttcactacctgttctaccctctcgataaacccttttttcatcttattatttcgttttaaggctttgctccatcccccgatcttgttgtaaacccagaaggaatgaaccagaaccacattaaccttgcctattttatccttggtggtcttattgtaaatctcaccgccgcactcaaactttgtgcctttgatgatctctgtgattagatcagactcactggcaactgtgtccggcacctctgtatatgccttacccacacaatctgctctgtgtgcatcacttccgcctgtacctgtgagattatacttttccgccagttttgcggctctttcattgacctccatggattcacaggcgttaaaagtctcaataaaatcaaattcctttaaaatatcaggatttctcttataagccttcgcattcataaagctcatatatttttccccgcagggatgagccggccccagtattcccccatagttgtgcactatggggatcagcatctggatcggaatgccccgcagctccaaaagcctgagcttaatgctctccggcatgataacaataatatgccccgcatccagggtgtcatattcaatacccttgagcacaacaaaatctgtgtatttctggcctttgatattttttttccaataacggaatcccccgtaagaatcatgatccgtcacaagcattccgccaaatccctggtttctcagcatacggatatactcttcgatgcttactttgccgtctatagaaccttcttttgtatggcagtgcatgtcaattttcacgacaaaacatctccttcccaacacactgcagatcctgaaataaatctacagctctaaaattcgtctcgcattctcccccaatatggcttttttctcatcctctttcatattcatttcccgtatgcgggataaaaattccttttgaccgtcccagggactgtctgttgcaaataaaattttatccattccatgttttctggacagacggataaactgctcatcctccatatgtcccaggctgtaagccgtatcaaaataaagcctgctgcctgccagatacttttccacatcctcccagcagttccagccgcccatatgtgccatgaccaaaatgcccccgtctatctgacgaagcacccgctccacccgcttgggcgtgcagtgcaccacctcaggaagccccacatccacccctgcatgggcaacgacaataagtccccgctctgccgctctgtccataatacgcatatagcggatgtcatcaataaatactctctggtaatcaggatgcagtttgatccccttcagacccatgtccgcgatctggtctacctcggccttatagttctccgtgtcaggatggatccctccaaaagagagaaattccccgccgccgcaaaactgctccggagttatctcccttgcgtatcggttgacagatgtaaactgctgcggctttgtcaccaccggcagtaccacagagatatctacccctgattcctccatggacctttgtagtccgtcctttgtcccgtctgtatacgcgggagaatccgatgccttggaaagcttttctatggttgccccggctattttatccgggaatatatgtgtatggaaatctatgatcatctcttcggccccgcttatttgtcttccttctggataccaaaacgtttcagcaggttctcaaactgttcactcatgacgatgagattaaagccctggggattgaccacaacgccctttgccagcggaattaatattttgtccagatttttaaattctaccaccacagccttaaactttttctctttgttgaattttgcaaattcacccggatctgtaaaaataggctggaatacatcaccgttcttgttcttgatatagggaacctgaacgttttcctggccttcctcctgtttctccaccgctaccaggaatttgctttttaccaggttagctgccatctcctcttccagctcattgatactcgttttctcagacatatccacgcctcttcggaattcctgcatgaaataaatgcccgtgagctgaagctggggattaaacagcggtctctggttctccggaagctgagaaaaatcaggctttttcacgatctcctccagatcgaagggtgttgtcttgtctttttccacaaacacaacctcattgacgcccagcgtaaagagagtggagtagaaattcagaaaactcttattctctaccttgatagatgccacaggatttttcgtctccatatatggctttgccttctcctccaaatccttgctgtcctcaaagacccacacctgatcattatatgtctctggatcacagatgataaaaggattgttggtccctctggaaaaaagcacataaaaagcttccatctgctgaattttcttaatcgtgtccaatcttactttgtccattgtcctatgttctcctgttgtatattttagtaatattttatttttttaatggcagaaaactgccggctttttcttcttttagtatacacctaaatcctgttcttgtcctcaaaaatttgcattttgccccccaaagcatgtagacgggaaaacgttttatccaaagcgtgtatggggcgaccggtattaaaactccaacacctgccctgtctctaccagaatacaggtgtccggaaatgccgaggccatcatcccggcagctctttttcctgtacagtgcacaggaaaaagaagcggaatatccatccttctcagactctcgatcgtctctttgatcctgcctgtgcctgcctttcccaaatgcatacctgcaaacacactgtagacaggcatatccggcagaacttcctttgcccgcaggatgcagttgatcacacctctgtggctgcatcccatgaacagacaaagccctttttctgtacacacagccagtatctgctcatcctccatctcatccgcccgccagaccgcatctgcacatctctcatcccgtatccagaatccggccggccgttcctcaaaatccgtgcggtatggaatatttccgatcagccagaacccgggtgctatttcttccgtagccccggtaaaatgaacattggccatccagttttcatggtttcccggaatgccaatgaaatgcctgtctttctgcgtgccgctgtacttcttttcaaaggcacttttttgtatgtacacaggcggcagcccgcggcttttatccagatattccatacctccgcagtggtcgtaatggccatggctgagcagtatgccgtccaaatcttccagatccacccccagagcttctgcatttttcaaaaacacatcgctctgtccggtgtccatcaaaaatctcctgttacgctcctcgatcagaacagacagcccatgttctgccagaagtccctgcctgtaaactgtattttcatttaatatggtaatcttcattttcgctccccctgcgtccggacagttgacagtttcgcagcatgtccctctattgcagagaaggcatggggaaggtttgaaaaccgtattccgcctccccgttgtcccactttgccttcacactgtaaatatatcccggttctgcctgcaggacactgccctcttccccggatgtgactgtcacagactctcccttttgttccgtcccggcgtcctctgcctgcccctgtgcagaggagtcatagcgcgtcacggttatctcttttggttcttttgaaaagacaagcttcacatccgtatgctccggtatctttatctcctcatactcgctccactgcagaatagagggggcatctgtggtctcactgacggtctcaccatcctcattctcatattcccatcggtatccgccgatagtattcacaacggcagtaaccttcgcctggggctggctgtattccagatccaaaaaaggcagggaagaggcttcttcctggtaactgaactgctctaaaagctcaccgtattgttccagaagcttccggttctgtttctctgtcctcacgatcctggtaatgcccggatactgtcccggataagacatggtcataatgccattgccgtaaatcttcacaacatcaccgttctccagctcccactgggccagattttctccctgttcatccagaatacttccctccggaagcggtcctgtaaacggagtgccgttctgtgtattgacaaacagataatttcctatggtctctccgctgccatcccgtaaaaacaaagcttcgagtgctgtactttcagcctccctgtcctttttctcttttccaaaccagaaaaccgaaacagccgcagcagcggccagcacacctgtcactgcgatcacaataattgtctttttttttcatagtgtattcctttcctgtttatattccatattataccctaagttttcatttattccaatgacagatataaccataaaaaatagaaaaaaacagcggagggagaaatcccccttccgctgcacttatatatcaactatttacaaacttcttcgtaaagattccttccctgtgcatcaatgaccactatgacaggaaacttttccacttccagcctgcggacagcctctgtccccaaatcatcataggcgatgacctctgccttcttaatgcactttgagagcagtgcccctgccccgcccacagcggcaaagaacacagcaccatttctgacaatggcatctgtgacctctttctttctctttccctttccgatcatgccggtaagtcctaagtcgagaagccttggcgcgtatttatccatacggctggctgtggtaggccctgcagagcctatgggacggccttccctggccggagtgggacccatataatagatcacatttccctccatctcaatgggaagcttctctcccctgtcaagcgcctggtccatacggagatgggcagcatccctggcggtataaatggttcccgtaatatacacataatcgcctgcatgaagtgactttacttcctccctgtcaagcggcgcgttcaaatatctatccataacaaaacctccttcatatcctcacaccggaatcagattgtcctaactatatgccggttcacatgacagcagatattcaccgccacaggcaggccggcaatatgtgtggcatatgtgttgatattcacagcaagtgccgtaatatctccgcccaggcctgcaggccccaggccgatctcattgatctttgccagcagttcttcttccagttctctgatatgttccagttctgaatgggttcctatttcccttgtcagggcttttttcgccaaaacagcagctttctcaaaggtacctccaatgcccacgcccacaaccaccggagggcacgcatttggtccggcctccctgacagcactgacgatggcatcctttacaccttccacgccgtctgagggtttcagcatgtagattttgctcatattctcactgccgaaccctttgggcgccacagtgatctccacctgatcccccggtaccagctcatagtggataacagcaggtgtgttgtcctttgtgtttacacgaagaagaggatctcccacgacagatttgcgcaggtagccttcctcatatcctctgcggacgccttcgttcacagcctcttccacgctgccgccctcaaaatgcacatcctgtccgatttttaagaaaaccaccgccatgcctgtatcctggcagatggggatcatatcctttcctgcaatgtccagattctccagaagctgtcccagaatctgttttgccagcggctttgtctctctctcacaggcagacttcatcgccctgtccatatccggggcaagatagtggttggcctgaatacacatctctttgatgttatctgttaaaagttccacgtttacactgcgaaccatgcctttttcctccaaaatttatttcttccctgttcagcttaactgctgcttcacatcaattcggttaaagtctgacagatcctcagatctgtgttttccgatcagtcccaccagcatataatacccggtcctgggatcaatgggatagtcttttaccagggtgaaatcctcgatttttcctgtgctggacacatgcatacgcggtcccagacattccaggaccatctccccgatctgcacatggttttcatcgtagtaggacacagacagatcctgcttcaccgcgtccttcacttttttctccagctcgtacagatccacatccggcttattctcaaactccagcacgaatccgtggcgcacatccgagcgcggaccgtcctgggcatagccgtcacccatataatacacgcatagatcctccaaggtgtgggccatctttctgtattttacggatttatgtacaatattggcgatgttttccggcagagggccgaacatattcggtctggtgataatgatctcctcaccgattcccacaagcagatccgcgtttctgtgcagcatgggataaatcaaatcaaaatgttccacaatgacctgcttcccgtgattggcagcatccaaaatggtgtctgccagcacatgcatctgggtaaatgctgattcaaagcgtatatccagatgataggtgtgcggggaaaagggatctgtcagatcttcatgaagaaggggcagggggcggatgttcacgccctcatcatcattggtcagatcaatgccgggaaacattcctttgatgagcaggctctttcctgccccggcatctcctatgattccaataatatggtcaaaagggcttaaatacatctggctgagctgcattcccagatccgccatacgccggtttcctctgggagcaaaataaaagctgtacaggtttccttcctgcatctgttttgaatatgccatagactcttccttcccaatatgctgaaacagccggaccgtcctgccggcaaaagcccgcagaacagtctggcacgtttcaaaaatttgttttatttattcttttttgcgtttctcagtgcaatgatcctctgcatttcattgtagacgatcatgtagccttcatcaactcccatgcccggttttgccaggatctggtccggtttggtagccattgcgcagtttacacatacctgagcggaacggtctgtctcgttgcaggtaccgccctgataagcgccgaagcctttttccttgcagtaaagaacagcttccacaatgttgttgataccgcccaggtcaggagtcttgatctgagccatatggcctgatttgttgtcagcaaagtatttgacatcttccaaggtgttgcaccactcgtcagcaaccagctccacatcaatgcctcttctgtccacttcttctctcagaccttttaagcagagcatctgtttttctctctcctctgcgtccataggtccttcaatcctcaggtggaagggttttgcagcctcttccagctctgccagataatctgccatagctgtgtagttgtccacgccgaagatggcaccgatggtaccgtatacgtcaatgtggaatacaggcatgtagttctcatcgctgcgcagcttcagcacacggtcgctgagccatttcacatactcttttaagagttctccgtgctcgcccagctttgtcttcacattattgatgagagcatggggcataactgccgcgccttttaagatcatcttgtcagagttgtcatatctgttgtcaccggactgggtgaagattgggatcggctcctcggaaaccgttgtgccgtattcgtctgccactacctcacacataagtcttccggaagcttttgccactgcgtccagaatcgcctggctcacaccataacggatggctgtatgcagtctctttccctctacctggagattttccagcatggcacacatatccttgaagctgtctgcttccctgcctaccagttcaggcttgatatacttttcaatgatggggataaagtcctctgccaaaaacagcggatcccttccgcctgcgccggaatactgtacagccgcgcagtctccccatgcgatctgtccgtcctctaagatcagcataacggagatggcttctcctgcctgtcttacggatttgaatcccggtgtcacagtctcgccaaaatatgcggaaccatctgccacagcaccttttttgatcgctctctgatcatcaaagaaaaaccctgttcttgctttggaacaaacaacatctacaattttcatgatacacttctcctattattgtgattttgtgtaaccgcccagatatctgaacggttacgatcttgtaactatgggatatgccttcacttttatttaggtttgccaaccagtcttcctttgctgatggcatatacatcgtcgatgaccatctggaaggatgcttttctcttctccatcttcgccctgtgctcaatcttgccctggttgaagtcttttaactctctcgggagcggtacattggctacattcaggtagcgcacagcgccttcaaagtcacgggccggcagcattttacctgcattgtatttactgggggcaaagggaatatccagcacaccggctttcacgccgcggatagcgccaagagccagatcgcccataccaagttcaaaacacttgtccacgatagcacatgtttcccctttgataatggctttttcaagctctaaggcagagcttttcagttcctggtccgccaaaagggagatggcctgttttgtacagcgaagtccctgtgcattggcctccatagtcggaacgcccattgcctcgtgaggtgttttaacgataacttttgtggccttggccagagctgccacagagcttccccaggagataacagcgaaagctttggactcatcctgcgggaaaccgcccatccactgatgaagcactgaggtaactgtaacatcttcatagccgtatttttccagatactcttctgtcagctcctcgagaactctgagggccgcaacgtcctgtaccaggttaccgcactggccgtaacctacggtcacattcttaacaccctgctccgctgccagcatggcctcaatgatagccactgcattggacatggaagggggtaccagtgttcctgtcagaggaccataaggctcacggttgatggaaacgcctgcctcctcgtagatacctgtgagacggtccacatacatccaatcatagatggtcctctccaggggaacatcctttgcgtaaggaatattgtaggagataccgccgccttcataacttgtaaatccgcctgcgtagcagatttctgtcagcagcctggcatccggtgtgccgtgacgtacctgtaccggagtatccagattctcaataatggaacggcagccgaatacaccgtggtttacagccggaaaaccgttcagcatggatttctgggtgtggatagattctttgattccaacctcagcttcctcatagcggttctgacgggtataggagtcaatcgtggttggcaaaagatctgcctcgccgttgtcctgcagatactgcagcagtttgatatgctcgtcaatcaatgccacaccggctctgggctggatcagtgtttttctctcttttttggcatttgccagtttccgtgaaaagctcttgctctccggcatcgctttatggtaatctatggcctcctcaaagtttacttcttttccggtaggccactgttccataacctctttccgtattccatagaactcatcatcagataatttcttattccttatgtccataataagcaatctccttcttcatgatttccagggcagcctgcgggtactgttttgagagcagtcccatggcagccaggatatactttctatccaccaagatttccgcgttttccggccttaatgaggcaggattgctttcatcaaatagtgcatactttgcaatttcttctgtatgttttgcgtggatcagtgcgcctcctgtgacaaccacatattttacacggcgcagatcctttccgctctgtacataggtcagaccgcagggggtatagacctgttccagagaaccggcatgacgggcaaccgcagtctccacggcagcacatgccagtgcatgatccattttttccatctcttcgctgtcaggaatgtaatctgtgtggtgttccagataatccacaagctcgtttaccttgttcctggcaagccctgccattttcgccagctttctgtctcctgctgcctccatgatgcctctgacgctatagcgcatccctatgtctccctcgacagtccgcttggtgtatggctcctgcagtcccttgatgactgtcgcggcgttggccgggcttccgtctgccacagaatacacgtctgtggtggcaccgcccagatccacacctaccagttccccgattcccggaatctcatcatagccgtctgagagaagctccatagctgtcagcattgccgacggtgtgggcatgataatgccggacatcagatccatggcctgggtcagcccctttccctgcacaatgcggttcaggaagatttcccgtatctgcttctgggtgggttcgatatttaactcgcccagtctcggcattacattttcacagatataggtggtccttccctccaggatctcctggcagtcatccgcgcagcagcggtttcccgcgatcacgatgggacagtcatagctaagtcctgcaagcatctttgcgttatacagaatacagtccgtatttccgccgtccgtccctccggtgagcagaatgatgtcaggatgatattcctcgatctccttcatatcgcctttggtgagctgaaaggaataagtcttccatacctttgcgcccgctcccagagacgcctctctggaggcctgggccgtaagctcgggaaccagtccgcaggatatcattttcagtccgcctgccgcgctggagcatgcataggtctcactgaactctagatggcctgtggtcttctccagaacctgtatcgcgtcatgaagtccattgttgatgtctgtctctactgttgtatacgctgccgccgttccaagaatctcacaattctccacgtcaacagctgtcgctttggtgttggtactcccaaagtccaccaaaagaactggtttcattttacaccgccccttttactctgctgcctgctgatcttcttccgggattcccaggtcctcataaagcgctgcaatggtggtctccggtgcagtgcccggtccgaatacacggtcaaatcccatggctttaaagcgtctctccacctcgtcaaagggctgttttccgactacgatattgccgcccacatagaggaggatgccttttaatccggcctcgtcacatttatcgcggagacctctgcagtccagctctccgtgtccgtagagagaggagaccataatgccgtcagcatttgtctcgatcgctgctgaaatatactcttcctgggaaaccataacccccaggttaatcacctcaaatcctgcacctgtaaatgcatgttccagaatactgatgcctaccgcgtgcacatcagctccgataacaccaatgactaattttttcttatccactgtaaaccgctcccttccagttatatagtatttttaatggtatccaaaagtgtgccgtcacggtacaggactttcgccaccaccctgtcgccgcgtttcacggctttcggtacacccgcagtctcttctgcgatcttctttaattcttttatatccttcaccggaagtccggctttcactaatttttccctcagctctttctgggccgggttgactgcaatgcccctctgcgtcacgatcacatccaccgtactgcccggtgtggatttgcagagtacctcatccacgataaggggaagtcttgcccttatcaggggagccaccacgattgccagcttagcgcccgccgccgtatcacagtgtccgccggagccgcccataatgtagccgttggagtctgtatgtacatttacattgaagtctgtatccacctgggtcgctcccaggatcactacatccagactgtccaccgcagcgcttttcgctgccggagaggcatagcgcatagcggagatttcctggtgcttgggattctcacggatggattcaatggctttcagatcaaagcactgtacatccaggatggtttcaaaataccctttgttcgccatatctaccagatatccggtgattccgcccatgcagaagcttcccttgatgtggtctttttccatcatctcctccacatacttcgcaacagccagggacgcaccgccggctcctgtctggaaggaaaatccgtcttttaagtatcctgaattctttaccacctgtgccgccagtcctgcgattctcagtcctaccgggtcacgggtgatcttcgttgttcccgaaacaatttttgtagggtcgccgatctgctccacttccactacatagtccatgtatccctctgcaatggaggtatctttcagcgggtagggtaccagattgtctgtcaggaccaccaccttatccgcatgcatagcgtcggagaaggcatatcccagggaaccgcaggcagacggtccgtacttgccgcttatgtttcccatattgtccgcacagggcgcggcgatgaacgcaatgtcgatcttcgaggaaccattctccatatctcctgctcttccgccgtggcttctgaagatcacagggcgctccaggatgccttcggagatggcctttcccaccttgccgcccatgtaattgcattccaggcctgtgacaacaccgtttttgatgtgttcgattataggttcatggatatcgaatatagaacttgcattcacattcaggtccctgatccccatctctgccgcctgagccagcaccatgttcagcacatagtctccatttctcatatggtgatggaaggaaatggtcattccgtcctttaaacctgtcttttcaatggcctcttttaaggagcctaacaatttactcatactgcgcacctccataaatggctttctccatctccagcacctgggaggcgcgtttcattatgggggcatctatcattttgccgcggagagatatcacgcctttaccctgacgcttgccctcttcaatggcatccatcacatcatgggcataagcgatctcagactccgtgggagaaaatacagcattgacaatgtccacatggcggggtgaaatgactgctttgccggcaaagcccaggctcttggcaaactctgtgtctttttcaaggccttccatgtcctccacatccgtaaacggtgtatcataggcttcaataccgcaggccctggcagcacacaccagcctggttctggcatagaatatttcatttccctcttttgtccgcttacagtgcaggtcagcggtaaaatcctcaccgcccaaaaacaggccgatcactctggcgtctgcggacgcaatgtcaaaagccttttccacacccattgcggtttcgatcagcggaaggatcttgacagccccctcctctatgccggccgcccgttccacctctgccatacaggcagatacttcccggatcatatggccgccgctgacttttgtgggcatgataacatccggtttcaggggaatgacagcttttaaatcttctttccagaacgctgtgtctgtgggatttatccgcaccacggtctcacagcccccataggactgatagcgaagagcgtttctcacaagaattctggctgcatccttctcatccggagatacagcgtcctccagatcaaaaatgatcgtatcagctcccagggtatcgccgttgatcagcatgttcggcgtattacccggcaaaaacaacatggttcgtctcatgactgttcaactccccctctttttaatgcggtctccatacgcgcccggatcacacaatccaacgcgcctttgtctttgataaaaattttccctgtagacacttcaaattctttcagtgtgtccagcacagcagcccgaatggaatccatatactggttggctactacagagtcaatttccagggtcagctctttgtcatccggctcgatctggataaacaagtcactggattccagggttcctgctactgcattcttgagaatcttcacaggttatctcctttctgcattacatatctttttcttttatttttggtagaaatattgagaacatttcctccgcacaaaagtccgtcgactccggcttttgcagaaacctctgccatgaacagaaccttctggaaaagccgaaatcaatcggctttctctcattcttccaccgcgctcttggagacatcggcctgtgccagtatctttttctcatatgccagagcgtttttttctataactgcagcttctttggcggtctcttccacaaaagcctcgtccttaatggattccaggttgatctttacattgaaaagtgctcccaaaacggctgttctcgccatcatggtggctaccagggcatctgtcacggctgtcttattgccttttgtcaccatgacttccgcgtagggcattacctcgtaagcacgttttgcaacagataagggaaccgcaacggctgccttcaggccgtcctgcatagcctttgtgcgggctgccttctcttcctctgtctctttcgggagtgtcaaagcctgcatgtacaggtcaaaggattcgctgtcacgcttgatgtcatccagaagatgctcacagatctcatgcatgggagcaactgccttcttcatctcatcttccacttccgcatatttctttttgccaatggtgagtcctgccaccatctcagtcagggctgccgccagggcaccagcaagggcggaaatacttccgccccccggtactggttcattggaggctgtctgcatggcaaactgttcaactgtcatatttttcatgatgtgtaacctctcctaatcgaatcagatatatgtcgtaatataatttcttacagacgtgtctccagaacctgtttggaatcaaagccttcaaagcctaagtaatactcagcgcagtcaacgatggcctgcagcgggatcagtcccactacctcgctgcccagtacattgacgccataacgtcttgcttccatgcgtacggtctcaaatactgtatatacagcagtctttgtatagtctgtcaggttcatggacacctgagcgatatttctgtcttccagcataacgcccatggctttgcagaaacggaagccgccttttacgtgacggatcttgtctgcgatcttctgtgcgatctccacatttggagtatccaggttgatgttgtaggcgatcagaggcattcttgcgccgattgctgtcacaccgccggtagggtgaatggtgttcgggccaaagtccggtttccatttttcctggtctttcattttctcagccattccctcaaactgtccctggcggactttagccagattttctctgtgaggagctgtagctgatttctcatataagaagaaaggctgaccgaatttctcagatgcctcttttgccactgcttttgccactgcatccgcgtcttccacagtcacgccgcggatggggatgaacggaacaacgtccacacagcccatgcggggatgctgaccctgatgttttgtcatatcgatcagttccactgctttgccaatcgctgcaaccattgcgtcctttaatggttccggctcaccgatcactgttacaacgcttctgttgtggtcttcatcggaagtataatctaaaagcttaacgccctctctgttgcggaagcagtcaacgatcttttctactttgtctttgtctcttccttcactgaaattaggtacgcattcgataattctttccatgatattttctcctttatgttgtaatgaattttgtgttgcgggttaccattctttatgataaacagtatcgccattcttgatgaccgtctccaccagattgatagcggtgtgatacggcataaaatgaatggacgggaatttcaggaaaataatgtccgcggcttttcccggttctatgcttcccactttatctgcccggtcaacagcggctgcgccgttgatggtcagagctgtgatgacttcctctatggacatattcatataaatacatccaagggcaaccatcagcgggatggagtttgaaaaacagcttcccggattcagatcggaagccagcgcaacagcgcagccctcatcgatcatcttacgggcaggtgcatactcctctttcagcccaaaagcagtcaggggcaggatcgtactgatgacaccggcatcccgcatctggcggattccttcatcggaagccttcagcagatggtccgcagagacagctcccactcttgccgcaagctcggaacctccaagctggtaaatctcgtctgcgtgaatcttcagcttaaagcccatttcctttgcttttgtcatataatactcagagtcttccacagtaaatacattcttctctgtgaaaatatctgcaaattctgccagattctcctcttttacctttggcattacatggtttaactgttcgtccaggaattctctttcttttcccttccattccggtagtacactgtgaggacccaaaaaagtagatacaatgtccaccggatgagtctcattcagtttcttcatggcacggagcattttcagctctgtgtcgcagtccataccgtagccgctcttgccctcgacggttgtcacgccaaattccagcatgcggttcaggcgctctttgccggcttccatcagttcttcctctgaggcttccctggtaggtaccacggtggcgttgatgccgcccccgcgttccataatagacatgtaactgtcacctttcagtctccaggagaactcatctgcccggtatccgccgaaaataaaatgtgtatgggagtctacgaatcccggcattacagtctttcccgatgcatccgtcacttcgtattcttccatatttacctgtttatccagttcttctgtggtacccacagctatgatcttatcatcatggatgatcaccgcaccgtcatagatcaggccgatatctgacatttcttttccatgtttcggcgcttttcctttacaggtcacaagctcagaggcatggcgaatataacgttttttcatgtcttgatctccttctaacggttctcagtgatgaacgtggtgttcttccaccactacatctttgcatactctctcgatcatatcttcatctgcaaggtacggcatggtgatgtaatcctgcccttcccttatcttgttgtactcggctactgtctcgatggagtgctcgcatcttccccagctcctcctggataccccgatcatggtatcccacgggatcgctgcccgtaagatctcatccacacgctcgcttccgtccagcaccattccgaatcctccgttgatggatttgctgatgcctactccgcctccgttgtgcagcgcgatcaggctcattcccctggctgcgttcccggcataacactgtactgccatgtccgctgtgatattggagccgtcatagatgttggaggtctctctgtacggggaatccgttccgcctgtgtcatgatggtcacggcccagcatcaccggtccgatctctccatttcttaccatttcattgaacctaagggcaatatcccttcttccaagggcatcctggtacaggatacggcactgggtgcccaccaccagtttgttcttctccgcgtcacggatccagatgtagttgtccctgtcctggctccttctgttcgggtcgatcacttccatggccgcatggtctgtggctcttaagtcctccggttttccggacaggcagcaccagcggaacgggccgtatccgtagtcgaacagctccggtcccaggatatcctccacataggacgggaacacgaatccctcactggtatcctccccgttcttggcgatatcctttgctcccgcgtcaaacacggcgcgcatgaaggagtttccgtagtcaaagaagtaggagcctctctccaccaatgtcttgatcaggtggtagtgtttgatcagggtctggtccaccagctcgcagaacttctctttgtcgttggccagcatctcggtgcgctcctcaaaggtcagtccctgcgggcagtaccctccgtcgtacggcacatggcagctagtctggtcagacagcagctcgatcttgatgttgttgtccaccgcgtactgcaaaaggtccacgatatttccgtggtaggcaatggatacggtttctttcttctccatgtattcctctgccacacggaacgcctctgccgcgtcctcgatcaccaggctcacccagccctggctgtggcgggtctcgatacgggaagcatccacctctgcaacgattcccacgccccttgcgatctctatggctttcggctgtgcgccgctcatcccgccaaggccgctggtcacgaacagatggccggacaggtctccgtcctgaggcacgcccaggaacttacgtcctgcgttcaggatggtgttgaaggttccgtgcacgataccctgcggtccgatgtacatccagcctccggctgtcatctgtccataggaggagcagcccatagctgtggcctttgcccagtcctccgggttatcgaacatgcccaccatcaggccgttggtcacgatgacacgggggctggtcttgtgggatttgaacaggcccatgggatggccgctcatcatcaccagggtgtgctcatctgtgagttcctctaagtatctcttgatcaactggtactgcatccagttctggcagacctggccggtctctccgtatgtaacaagctcatatgggtacagggccacatcatggtccaggttgttgtcgatcatgacctggaatgcttttccttccacacagtgtcctttatattcatcgatcggtcttccgtagatcctgtccttcggcataaaacggtatccgtagatacgtcctcttgtcagaagttcgtctaaaaattccggtgcgagctgttcgtgcagctcttccggcacatatctgagggcgttggccactgccagcttgatctcccttttgttcagggtcagctctctcttcggggctcttctgacaccctctttaaaggtagggtattccggcagtacgggatccagttttatcaccattgcttttccgatttccgcattgttcatttcacatcgtctcctttactttttttatgattttagcactgggacagtctaaaaaacgtctatttctgataaagttctacgatgctttgatttttttttagatattttaaccgaaatcccttctgtattttagtctgataaagggaaaatgtactaatataccagaaagtattttagctatttttgcaacaaatgcgatttcaggaattctgctgccgttaaaatgtattttattctgtttttttgcttaattatcatatggccttcatcctcaaaacagagatattccacttctcttcccagggctttcagccgttttgccgcgttctccgcctccgttacaggcactctcgtgtcattggctccgtgcacgatcagcaggggacattccagatcttcaatgacagcttccggtgagatatcttccagtaactgtatgtcatgttccagactcccatattcagcctcccttgccgctctccggtaacctgccgtatgcttcaaaaagctcaccagattaaacattcccaccacttccactgcgcaggcccagagcttgggcatcctggcagcacaggaaagagtcatatatcccccgtagcttctcccgaaaaccgccattcttcccggatccgcagtttttgtctctgtgaggtgttccaccagcgcttctatatctttcactgcgtcaagacgcttttctttattgtccagatccaggtaagtcttgccgtatccggagcttccccttacattaggggccgctaccgcaatcccctcactgacaagatactggatggtttcctcgtaaaaacgtctgatctgagactcgggtcccccgtggatataaaccgccaccggcagattttttgcaggcattccctttggaatatagagccagtaggggatctcaaggccgtcaaagctctgacagcggcatagcacaggctctgtcagcatatcctccgtcactgccgtgtcttcattttctgtcacctgttccagagtacctttttcagcgtccagcagccagatattctgtatcctgctgccgctttcaaaagaaaagagaagtctaaagcctgcatctgaccacgtgacaggttcctcatcccctatggttcccagagggatctgagggatatggatctctcttttcgtttccgcttccagaatatgtatcctggaatccccgtcctcattcaccaccacagccagatacctgttctgtcctgacagggcaatatgggtcacatcccagttcacctcatagatttcctgtgtgaggcctgttttcctgtcccagaacatgacccttttaaattcccgctccctgtcgctgataaaataaaaaccgcttccgtcttcaagccatacagggctgtcttccatagcgcactgcagattccggctcacctttttctcctccccggtgagaagatttttacaatagatctgcagatctgcaaatgaggttcttctgctgtacaacagaatctcctcgtccggacttatgcacagcggaaggcagaccgcatcctttccttctattaatatatctgttttaccgttctccagattttttctgcatatatcaaaaatactgcgcagtcttttattagaagcgtaatagacccagctgcccctcacatcccccagatgactgcgcacattccttggatggtacacaacaggcatgacctcgccgctgtcaccgccgatactatatatttgctcgttttcatctccgtccatatccatagcaaaatacactcgtctccggcagaaccgcatccggctgatcttatcgctattatgtgtccttttcctgtttttccccgtgtgcaggtctttttcccagatctgaggcgctccatccctggtgtccaggtaataaatggtgttctcctctccccatacagggtaactgcattttgctgctgtcagataatctcttatatttcccatattccatctccattagtctggaatccggatgatctgttctggtctgcctctggttttccgctgtttggtgcccaccacctgtgccgcgtctgcagccaccatcttctgaagatatttgctggctgcgcgcactgtgactcccaagctgtccgccaaaagctgggctgtgacggttccctcctcctgtttttgggcaactgtgcatatcttctgcagggtcagcgccgaaattcccgtctcttttgccattttggcatacttctgggagggggttgtggacagtatcatacagctccctgtaaccagagggccgatcaagttttcgttttcatctatggcatagctggcaccctgagggtgcatcatggattcctggttggcattcatggcctccagtcttgcacgtgtggtatctcttcccagtccatatccgatgcataccctggcgcctgtctttctctccagatatttcttcagcatgcagacagaatatttctccgtgatcctgtcaaccacgccggcgctggtgtaaacctcatacacagaggcatgcctctgaagcataaaatcgcagtcattctccttggaaaactgcaggatcgcagtctgcatggcaagctcttccagctcatcccggttctgtccgcctctgtctccggtgatattgatgaccgccggcatgctctccttcattttatccatctctatggtcatgagtagacggttgaccacatctctcatgtaaggaatgccaggatatacaaaatgacagggaatccccatctccttaaaatcctcggctgctgtgctcagacgggtgatgacctggtctatctgttccgcctcccacttcttcctgacatcctccaccatcttatagcggagtgcctttaattcctccaggctcatgtgcgccaccatattacagaagttatcgccttccgcatccagcgtatcattctctacggcttccctgatgttttttcccatcatgaaatccgcatagagccgttccgccttcagatccggggtcagtgtcataagcctaaagagttcctgatagtaggccagcatgtccacatggaaggtctcgatgggtttttttgtgtccggacaggccgcgcgcagcaatgctctcgatataatgccgtttacaatgaatccatcgtacttgtcttcgatacttttatagatttccggaatttccgatgattgtttataataaaaggcagtaaacgtacagcgctcttcaaaaggaaggattgcctccttcaccctgttctccataaattccgtgctgatgactgctgttctgtatttcatagtctaccacctttcatgattaattgaatcgttacgtttagtttactacgacttcacattcgccgcaagatatgcttttgcaccgcaggcgaaagccgcagctccgcttgcaaggctcgtctcatcatagcggacctttgggtggtgtcctgagaattcatacccgtgttcccggtctcctccgcctaccacaaagaacatggagggaaccaggcggctcacctcggcaaaatcttcggagccggaggtggtctggctcacacgggcagccgcttttccaagtgtttcggaaaatccttttcctataatatcagcgcatgtctcatccacagtcagggcactgacggaggccggaatctccaggcttgcttttgcgccaaacatcttggctgtcatctcaacacagttctcgatccttgccagcagatattccctggtctcctgtctgaccgtcctcaaagtaccgcccagataagccgtcttaggaataatatttttcgcgtctccgctgtggaattctccaaaagtcagagcagcctgatcctgagggtccacttctctggcgatcagctcctggagagccagatgaatgtgcacgcccacattgatagggtccacagacagatgggggctggccccatgtccgccttttccttcaatggcaatgtgcagcagatcactggaattacacacaacgcctgcattgtatcccacaaatcccgccggtgccaggggcatcatatgtacccccatagccgcatccacacggggattctccaaaatcccgtctgcgatcatggcttttgctccttccagtgtctcctcccccggctggaacataagtttgacgattccgggaagctcctcctcctgctccttcaaaatcttcgcggcgcctaaaagcatagctgtgtgcatgtcatgaccgcagcaatgggcagctccgtctgcggctgcaaagggaagaccgctctcctcctgcataggcagtgcgtccatatccgctcttaaaaggaataccggaccgtccgtcttttggccgatgagggcagtgacaccgcagcccccgcagattttcggctctattcccatgtcacggagtttctccatgacaaactctgtggtaaccttcaggttcatacccagctccggattctgatgcagaaatcttctgttggcgatcatctccggaagaatggcttttgctctctctagatcgttcatttttttctcctttatttttcattatttgtttcactgttacctgtttcctgctgatttttcccctgtatgacatttacctgccctgacttaaagaaaagccaggaggagaggatcatgaccggtatggtgatcagcacaccgatccccctgttgagctttgtcacaaataccagaattcccagcaggattaaaatgggggctatcatcatcttccactttcctgtgatctttcctcccgccggatttgtcaccataaggcggatgaacatacacccaaagagggccggcagcatgtaagaagtagccacctggactgtgggggagcttaaaagaggctgcaggggcaccagcatgagcacacccacaatgacaaccgctatggtgatcaaggaggacacggcaatggcaatggtacacaccgcgtccccctcatcggtattctgctccgcttttgctatgtccagggcattgagggcgcagggcagtttaatgttggacacatttccggtgatcaggctcatgtaaatggaggagcctaaaatgggggtataggtgactgactccacaattccagtgggaacatacaaagccagcagaccgccgcagaacatgagaagatctgccgcctttggccacatgtcaaaatatgtacacgtagtaacaggaatccccagcatgatcaaaatagcgatcacggtaccggtcctgccaattctatggacagaattggtgtattcgcttaatccgtttttgttcattctttcctctcctttatcccagaatatttacagtgcagacagcagcggccatgcccatgagcagggctgccgacatgataaagctgccaagccactgtattttgtatttgcccacaatatagaacatgaccgcggacacgcaggcactgacgatcagcaccacgatccccacaggccctcccagaataatataggggatgaaggcggcaacaagagctgcggcaaacgaaaaattaaaaacagcgccccaggctcccttgcttttcctgtatcttgtcatacttacctggattttttttgcacagaaaatatttgttatcattcctgccaaaatgcatatactggttacgaacatgatcgccccgaacacttcataattgttggctgccgccatagcacctgctgactgaaaccccagggcatcggataccatttccgctgctgtcagttcatagctcaccgcacctaccacggaaagccggaaccaggaccagggaacacccagcactgcggaaagggaaaagagtccgataattacagatatggacgggattacggtaaacacagcagaggacttgacaacttccaagatcgtcttttgggtaattccaagttccagtgcccgcctccaggctttgcgcataaataccagcacaagtccggaaatgtacagcagcccaatgcccaccagtatatagagcagtctgctgtttgccacatcaaaataattcattgtttttcctcctgttgttttgtgttcttttttttaattaaaagaacatttaaagaacgtacgttaattgtacaataaatcatattagcattttagtcaatatatttttgtatttttctttgtttttgtaaatatatcacaaatctagagtggttttttcgtggtatttgcggggtagtcagaatttatttttgatgtacaatggaaataaagaacgaaatgaaccgtttaaccgaaggaacggttacgaaagaaacagcttttcaaattgataaaggagacagaacacatgatatcacaggattgcctgcacgatgctttgtcctacggaaaatgcttcaccggacttggacagcccgcagattatattccggagcttgcccgggtaaacaaacaccagctcggtgtgagtattgtaaaactggatcaggagattttgaacgagggagattatgacaggccctttaccatccagagtatctccaagctggtatccctgatcctcgccctgcatgacaggggcggcgaatatctttttcaggacaaggtaggcgtggagccgaccggagacccttttaactctatcataaaactggaaaccaagacacgccctttcaaccccttcatcaatgcaggcgccattaccgtggcaagctgcatcgacggcagggataccgaggaaagattcgcgcgttttctcacctatatccggcatctgtgcaacaacgagagcatctgtctgaatgaaaatgtctatctctcagaaaaaagcaccggagaccggaaccgggccttggcctattatctgaaagcctccggaatcttagagggggatgtggaggactgcctggacttttatttcaggatgtgctctgtggacgtgactgccctggacatagccaatctcagtgctgtgctggccaatcacgggaccaatccctttacaggggaaacgctcattgagccgtcctgcgccaaggccctccgcgctctcatgctcacctgcggcatgtacgacggctccggaagattcgccatgaaagtgggctttcctgccaagagcggcgtgggcggcggtattgctgccgttgttgtggaccagatgggcatcggtgtgtacgggcctgctctggatgaaaagggaaacagtatcggtgggatcaagattctggaatatctggcaaaaaagcttgactgcagccttttctaactgctgtccttatattttcgtggacatgtagatcaaacggtaaataatgcgtttattctgttttccaggccgcgcaacaagaaaagcctcttcccgtaaaattacaggaagaggcttattaatattctatgccagatattcttcaatgaagtgagaggctactgcgccgtctgatgctgctgttacgatctgccgcagaggttttttcctcacatcacctaccgcaaacactcccggcagatttgttctggtggtctcgtctgcctgaatgtatccctgactgtcaagttctgtctgtcccttaaaaagttctgtgtccgggatcctgccgatagctgcaaaaacaccgtcgcagggaatttcccttctctgcccttctttatcctggaccacaactcctgtcacttttttctcgtgaaggatttcttttatctgactgttccagacaaactccacattgctttttttcaaaggctccagataaacctttgacgcccgcagggtatcccttctgtggatcagataaaccttcctgcatatctttgagagatacagggcatctgccgctgcgctgttgccgccgcccaccacgactaccgtcttatcccggtacatcatgccgtcacaggctgcgcagtaggcaacgccgcgcccccgcagggacggctcctcaggcagcccgatctctcttggagatgccccggttgccaggaccactgctctggcttttacctggcctttagaggtctcaatggtttttatatcatgcttcagatcaactgccgttacattaacaaatgctgtctcagccccaaaccgttcggctccccgctgcattttttctccaagctcaaagccgtcgatgccatcctcaaatccgggatagttgtccaccacactggtggttgccatctgtccgcccggcgacattttttccaggaccagaacagagagtccgcttctggcgcagtagagagccgccgtatatccgccggggcctccgccgatcactgccacatcgtatatatcctgtctcatttgtattcctcctctgtcaaagcacctggtttgtcttcagccactcttccaccgcatcctgggaaggcgggttgaccacacggtctgcttcttttccgtctttaaagaggatcagagtgggaatggtatctatttcgtactgctgagcaatctccggaagttcgtcaatatctgctttcaacactgtgactttactgcctatctcagcttccagcctttctaccgcgggggcaagtctgcggcagtagccgcaccatggtgcccaaaaatctactacgaccggttttgtggactctaatacctctgtttggaattttattttttcaactgcgtttactgacatacttcatcatcctttcgtatttgatatccggaagtgccggaattttttatctgtattgatattgtttacagttcctatactgttactatagcaattacagttgactttgtcaataggtaaatgtaattccagccctgcacaaatataaaaagacagacaacccaggcagaactccatgaaggagttccaaccgttttgtctgtctccggaattgtcggaaatcacagttttacattcacacctgcacttcggactgcctccagtatctcaccattcagaataagattcctcaccgcttctatatatggctccaacgcggcatcttctttcagggccggcatgacttcccttatttttgcataaaccgcttctatggcaggggaagactcgccttccggatagaattcttttgcctgcgcagcacagatcagttcgatggcaaggacgtactgagcagtcttcacagcatcacaggcttttcgggcggcattgtatcccatatttacatagtcttcctggttggcacaggtcggcacattgtctaccaccgcaggatgtgagagaagacgcatctcccccgcaagtcccgctgccgtgtactgtatcatcatcaagccgtcattaaaatcagcactggcatttaaaaaaggcggcagttcgctcagatggcggttgaccagacggtctgtacggcgttccgccatttttaccagatccgcaagagcaatgcagagaaaatccgaggccatacccaggtatgttccatccgcattacatcccatgagagcttctgcttctccgtctttttcaaaaataagaggattgtccaccgaagaatttaactctatggcaatggactcaagaccgtccttcaaagtctttttcactgccccgtgaagctgtggaatgcagcgcagggacaaggcgtcctggacacgataatccctgtacctctctgcgattttgctccctgccagaaggtttctgatgttttcggctgtctgcatctggcccgggtggggtctggcgcgcatcagcctttcgtccatggctttcaaagtacctttgagcatttccagagaaaaggcaccggacacgtccgctgtcccggaaagtatcacactgtcataataggcaagacaggcaagggctgtaacagatgtggtgcctgatacaagggtaagtccctccttggagccgaggaccgccggctgtaatcccgcgcgttttaacgcctccgcacccggaagaagttctccttcataccatgcctgtccctctccgataagcaccataccaatatgtgattctaaacctatatatcccacagagccatgcttcggaacccttggggtgatctttctgttcagcagttcttttattagttccagagtttccaggcgaaaaccggtaagaccgctgccaaaatgcaggagcatgacaaacatcatggctctgacaccttcttcatcaagaggctcacccacagagactgtatgtgctaaaatgtggtttctctggatcttaacacgctcctcctcaggaataaatttcctgcagttgtcacccagacccgtggtgataccgtaaatagcttttccctcacggctgaaacgctccacatgctgtctgcagattttgactctttctatgtatttagcagaaaattccaccacagcaccatacctagccactgctgctacttgctccagtgtatttctgcctcctaatgtaacgattttcatatatacctcaattcaattttttattattctcatatcccccttccagggacacactcatgatcttcagtctgcggtaaacatcctcttccacctctgcatcctccgggggcatctgctctaccggtctgctcccgaatatctcacctggaacaaacacccggccgcctggttttgcagacggacagctgcggacatcgtcagccagagcatccacctcttttgtaaaggcctccaaagtcgtaaacatatccggagaaaatgccacaaacagatagcccagatcatactcgtctttggcgtcatatcccattttggctcccacaaaagcgcctgtcatcacttccagagcataacacagggcataaccttttggtcccccgaagggcacaccggcctctgctttctcaggatctgttgtaaagtttccctctccgtcaataaaacagttatccggaagaggacggttttccacaattgcctggcgcacctccccccaaaccttctgggatgtggcaaagtcaaagatatagggctttcctctgccgcttgggaaagaaaaacacaggggattcgttccaaacatggctcttgctcccccaaaaggagccacacaggcggggcctccgttattggttatcattcccacaagaccctcctgtgatatttttctggcatagggggtgatcctggaataacgccccacatttttcagggctgtgatacccacgccgtgttcttttgccgcggcgatcgccagattggtggagtacagagccgcaatatgcccaagctctccgctgccgtccacctgggcatagcagcccttttgttttaacagcttcatctctccgcttcttctggacagacctgcgtccacagtcagaaactttgacaggccatgggtcctgtgtccctccagctcagattccagataatcggagatcataaattccgcatattcccccgtgatccctctgagggccagagcttttctcatcagctcttttatctcttctatttttactgtaacaaccataaatattatcctctctacaagatcgccagaagctcatccagcatctgggtctgccgtttatcatataccggcaggcggtatgcatccagacgttccctcaccatttcctgtgccttcaaaataacagagggcatgccgagctgtttccagttgtggtaaatctcactgttaaacagtttgggatgaaacagctctttctggtacagctctaaagtctcatcctccagcatataagtccccccggggcctactctcctgatcatgtccatatgaatggcttcttctgttatataatcacagttttccacggagaacctggcctccagcagttcctcgtccaacacgtatttttccaggctgaacacattgaggcagtccatctcaccaaaagcatggaaaataaaatccgtatcacagtcaaaagtggtcatcagggacacggctgtctccgcgccgtcctgccagtcaagctgctttgcgcctgagagagaacctcccactctggatggtataccataaaaatcagccattgccttggcgtactgcataaagaccgcaacctccggtccccaggaaatggggacagccttgcgcatatccgcactgtatgtcacattgccgtagaccaccggcacaccagggttgaccacctgggtcataagaacgcctgccagcacctcggcattgttctgtacaacggtccctcctacggtgatggggcttgtcatccccggcgcagagcagcaggtgatgacaaccggctggtttctcttaacataggccagggttgccgccacatcctccctgctgtaccgaaggggagaaatgacattctccacacctatagtgaaatattctcccatctctccgtaaaaatccctgataaattcaatggattccgccgcgctttttcccgtctcacaggacgcgatcagtggcttttgggaatatttcagactcagaaccgtctttaacaattctaccttgccgtccggaagatccgaggcataaatgcccggcacacaacacagatttacaaaacggctggtctcatccatcttggtaccgtcaatataatcttttactgtgggagtacagatctccccgtctttcaatatggtcatggcacctgaggcagtggagacggcctttcctccgtcccctattttcaggctggcaaaaggtgtctctatggtaaagctgggtttcaggcccctcaataactcctctgtcagggagcgctcaaaataaaccctctgtccatccacacggattcctctttttttgaacacctccagaatctcacggtgttcaaaattcacgcccacactctccagaatctccagagacttctcatgaatcatctgcacttctgaatcttttatcttcttcacaagcatagcaggttattcctctcttcctgtgccggctctgccatggtcccggccttcaatctatcactttttctttactgcgaacatgccttaaggatttccagcgtgccctttgtaccgtcaagtctcacaaaatctcctgtcttcacgcgcacacagggatcctcctctttggaaaaatccaccactgtcggtatctgcataaccgcgcttgccaccccggcactgctgtctattttggaaaatgcccatcccttaggcgcagaaccggctgccctggcagctccgaaataacaggaccatccgttggagcccttgctgcccggcatgatcaggatcgtgtcctttatgcattttcctctgttgacgttttcatagtcttttatcacaccggtctctgggtcgatacctccccatcctgtaatgctgtcagcgcacacaagcgcctcaccttccacaatgcccggtatcacacctctgccctgcagaactattttctccacctgtactcctccttccacacgccggaaactgctgcatcgatacagcggtatttgtccgtataatatacacgctcggcgcagccgtctgaacgcacgcttccggactgtttcaggctgtcataggcctgccctttgtagtgcttcaggaaacagtcacctatggtgaccggacaggtacttgtctgtatggttccccctgcatcttcgattattttcgtgtatccgtttaaatcagccatggccttgatgggatacacggtccataccataaatcttacaccatcatgtaccttttttccacaaatataatccgcaacttccttgatctgatgaatatcatagtgaggacagcccaaactgacaagatccacagagccgtcttccttgctgcacagctcctcataagctaaattgatgtcctgctgcgtcaatgtgaactcctcctgcacctcatgtcccatgaaagcctcctcctgcgtattggcctccggggtgatccccacaatgtggcacatccggcagttggtggtaatggcaagggccgtaaaaaagcttttcagctttacaaagtccacgccttcaaaattgccggtaagaaccggtgtacatccggtaaggggcagtcgttttcccatggcttttcccaaaacttcccattcgatcggtgagttaagctctgcttccacgtgtatcagatgggttccgaaacgattttccttcacatggtatccccagtatggcgtcctgccgcagatggctgaccagaaagccgcctcgattccatctgcgttgcagcatgctccccagatggaattgcccataatagtaacacctgattctgtggtcacaaaatgctctccccgcacaggcagccatcccatcagataaggggaacaggaaccggctatggtaacgcccgcctttctggattcctccagatagtaactgttcttgtcaaactcctctttgggctggtcaaagatctggtagtcatactggtcactggcagccacacaggactgcacataacaatccttgtccacactgtcaaagacgatcctctcatcacgggccaggttcatcctggaaaatacttcatggaaatccttacttttacagacattgaggtaattgtgactgccgcagaacactgtggcctttgtcactttacagagtctgtccgcccccagcacctgcgcatagcgcacaatattttccagtgccgtctgacagagctttcccttttttccgtccaggatatcctgttcttcctttgtcaaatgaatcacttgcattcctccgtttcctccaggatttcgatgatctcccggtccgcgtccactacgatcctgtccccgtcttttacggtttggtaaaacgcaggctctacccggtccaccatgggcacttccatgataatggcgctggacaccagaacggtttccgggtgctcaatgatcatagctgccggtgaattttccttctggttcaactgataaagaccatctgcctgtaccacagaacttccctttccgcctggaaaaatgagcaccttatgggcaacggatcttccctccagatcatgcgctttctctatgactgttcccgtagccgggtctatcagatagaacataatatggtcttttgatataatggcctgcgcttccgcgcgtccctcagaaatcttatggcatttaaatttttttcccatgtcattttacctccccggtgagtgctgcttcgatacatgtatccagatcacggataacaaaatggattcctcttctctgcggatagtaggcacatttcggtgattccgtgattcccactttccctgtcagatgtctccagcagggctggtccggacaactgtcaggcactataaacccgcctgcgccggtaatgatctcatcaaatcccatacggactgccatctcctttacatggctggaggtgaggatccacatttctttttccagtttctttccttctagtttttctgcgatatactttacttcctccagtgtgaaatgagggcatccgaacatggcaaaatcaattttcctgctgccatccagagatatttcttttaggatctcttccttatcctcattggtgatgaccaccgttttcttcggcttctttcctccaaaggcagtctccagatcgggagcctccggtgtgaatcccacaatgtgatacatgccgtaggcacctgaggtattcaactgtgcccccaggtttctcagtgcttcttttgtgatggtctccttgggaaatcctgtaaagacaggaataccctccccgatttttttgcccagcatgccgatgatatgatagtcaaaatcattttttacgtctgcctgtatgtccaccaggatatcccctttccggttctcatccagcaaaagaccgtattccggtacataacctgtaatggctgcacacagtgcgctgttggcaccctcccggttactccttgctccccacacagcgttgatgtagggcgttgcgctggattcagaaaaggccgtcacctccctgtaatttggcacattggtatcgatataaggggtgcagttatagctgagctgtgcccccagtgctttgtaggcattatgtgttctctgcatcagatccgcatattctggtgccaccatatccctgttcttgaaaaattccagacaaaaaccggggtttactgttggggtcacacggcattttgcgcctcctgccagcattttttctgcaaaccacaggtctgcctcctgattcgacaaagccacatgtgctctcgtaataggaaccattttttcggctccgaaggactctccgatcgccacctgtatcttcatggcataggctgtcccttttccatattttccgtccagcatatcctgctggtgctgtgtaagctgcatttgaattcctcctctgtttctcttttttaccggtactttcttctttttcggatgacgtagatccagactttattttctgtttttttcacttttcagcacgcatcccgcgctctctaacagtccgccgtcatggatccagttcctgagcttctccagataaggatacaggtaaatatcctcctccatgaccggaaccaggtctttcatggcttccagtaccgcttttgtcccctctcctcttgtaagggaaggatccacaaactgctgtgcctgatatgcggagagcagttcgattgccagaacatactcaaacttttctgctataccgagagcttttttgcatgcgttgtatcccatggatacatagtcctcctgattggcactggtggtcacactgtccacggaggccggggtggataaaattttcatatcattgagcagccctgcctgtgtatactggggtatcataagaccggaattcaaccctggctttttgatcaggaaataaggatacggcgacagtttttcatccagaaaacggacatttctgcgctcggacattttcgccgccgctgtggccgcaatacaggcagaatccatctcgatccccacataggacgcgtctggatttccattggaaaacacctgcgggtcatccgctgctccacacacaataggattgtccgcgcatccgttgatctccacctcaacagcagcccaggcatcccttaatgtcttcttcaccgcgccgtgaagctgcgggatacatctgagagataaggggtcctgcacatgagtcccctcggctttttttgtcacctgggaaccgtggagcatgcgtttgataatgtcggcagtctccagaagctctttctggggacggcagtttaacacactctcatcataggcgcgcagaagcccgcccagcatctcaaaagacatggcagccactaagtcggcggattccacagctttcagcagatcataaacggcaacagcagccagggctgtaggggaagaagttccgttcagaagtgccagcccctctttatagctgagcacgaagggttccatgcctgccctgtgaagtgctgttttgctgtccgagagttctccccggtaatacgctcttccctctccgatcaaggctgccgcgatatgtccctccgcacacagatatcccacggaaccttcccgtggtgtatacggtatcagatctttgttcaaaaaatcccggtaccgctccaacagctccatgcgcacaccgctgactcccatgccaaggctctgcagcaccatcaggataatggctcttacctcttcctctttgaatggctctccgacactggtggaatgggtcagtattatattcctctgtaatttctccgcatcctctttccctatggtctttgtgaccagcgcgccaaaaccggtagtggtgccgtatactacacgttcttcctccacacacgtctctacgatctttcttgatttctccacacgctgtctgtattcattagaaaaatccacttctgcatgaaaccgcaccaccgccataaattcttctatggtcagttttttgcccaatatcacctttttcattttaatctccattccgccgccaagtcggcggcacaaatagtaatgaaagtattccaacttctactctttggtgtaaaatagcttgtgagaagctacactacaaagcacgggaggagaagttgtaataactttcttcgttttagacagcataataatcagtgtaagttctgccttttcaagcacaaataagtggtactatgagtccgcacactaagaattgtttaagcgccttagtttaattgtgtggcagttcagtcaatggcctctcttcttttacgaaaggagtctgacttatgaaagttgtttatcaaacctgttgtggtgtcgatgttcacaaatcttttctcgttgccacaatcattaaaaccacttccggtgtggaaccttcgtatcaaaagaagcgtttctccacctttaacaattctattcttgaattcaagcactggcttctcgacaataactgccgggatgtctgtatggaatccaccggtaaatattggatccctgtctttaaccttttagaagacgaaataaacgtcaccatcgctaaccctaaatgggtaaaagctgtcaaaggcaataaagatgatacgaaagattccaaatggattggtgacttgttccgtcttggacttgtgagaggcagttatgttccttgtaagaccatccgtattttacgtgaatatactcggtatcgctacaaacttgtttcctgccgtaccagtgaaaagaacagatatcagaatgcgctcactgtctgtaatgtcgcattagattcagtagtttccgatatcttcgggaagtcatccacatccattattgactacctgcttgaacagtccggtcactctattaaccacgaagaaatcgcatcaaaacttcttagacgtctcaaatctaaaacagatgccgttatagaatccatcgagggatatcagatgactgatgcccaaaaataccgtatgcgcctcgtccgcgcacatatggattatatcacagccgaaatcactgatatagactctatgatagaaaatctgatttcttctgatcctgattatgaaaatactgttcagttactctgtaccattccgggtgtaaaacatgacagtgcaatcactatcatctccgaaatcggtattgatatgactcagttctgtacctcaaagcgtttatgctgctgggccggattaactccggggagcaacgaatctgggggtaagaagaaatctgttcgcattactcgtgctggtgtctacctcaaacctgcattagtacaatgcgctcatgcggccgtgaaatccgaccaatctccttactacaaaaagaaatatgaatctcttgtaaaacgtcggggtaaaaaaaagagccattattgctattgctcgtatgattctcactgctatcttccagatgctgtctactggtgaagcatggaatcctagtgatttatacaaaattgatatgcctgaggttttgcttgaaaagcaaaaacaaaaggctatcaaacaagcgcagaagttactgatacgcgaagggttattacctccattggaacccctggcttcctaaactaattatctgatctatacttttttacaggttaccatttctggtagcttattaaagtacgtcactttttggctatcctctactttctttcacactattctttcctcttttcccctttaaaagtttctgcacactacatttccgtctgccgctataggcatatatctggcttttgtaccttccaccatatctccatatatggctatataaaacggacggtatacctttctctcctcaaccggttttatcgctaaattccttcccacatgacgtctgaccatccgtcctgccatgatagcaccgcagtctgtaagccttttgtcttcatagtaagtgggctggatatcattttcttccacctcttttacttctgtggcaatgtcatcctccacataagatgcactacatgtggtggcctccaccatcactcggatcttctgcctgtcctcttcttttttcttcttgatggtcctgacgataatattgtctttatatgtcatttcataagtaatataacggctttccagatacataatacggaggttgattttctttcttccgaacaatgcccgtataatagggttttttcctcctccggcgattttgagagcttcctcttctttcattttcacaggaaaacattctatcttcataaatctatacctccatacaaatccttcactcagcggggtctgttattcagccagcccgctgatctttaccgtttgtcacgcacagggcggtcctatgcagcatatctgctgcatagccctgtacctgtttcctttacctgcttttattatttttttatttttcttttttcttatctgatccttttttgcctgtggcaaaggagacaacctctgtacaatacttcaaaaatacgcctacggttataaggattgcaattcccggcgccataatgccgatgataaaatcaacactgttcagcagtccatatccatagatacatgccagcacaatgtagaggagcaccagagcgccgtccacacccagccattccactttcagttctgatttttgctgttctgtcagttcacttgtattttccttgggatccttcatattgcttcctccttataatcctttcagtctgcgttctgcacttaaatcttttccgaaacggtttccgatcaggaaagccacaaaggaaagaggcagaccgatcagaaccgggtcaatggttacacccgatatggtcacaggccatatatactggaatacgatccaggtaacaccacccacgatcatacttgcaattcctgccacgtttgtctttttgccgtcaaacatcagcgctgcaataataggcacaaataatagggtcatactgatactgctcaaaaacagaaacgcatcgtacacacggtcaaaacggaatgctgtaaagaggccgataataccgaaaataacagcagccactcttgtgatcgtgatactgactctgtctttcagttttctgtcccctcggagcatgtagataatatcattggagatgatctccccaccgatcagataataactgtccaaagttgagatgatcgcccccagaattcctacaataaacaggccttttgccacaaccggcagatattccaccacagttgccacataggtaacttccggctggactgccagagcggtatcacgtacacggatgatcgttcctgtcataatagtcactacatcgaaggacagccagatggaaaagcacaaaagcatggctcttttgcctgtcttcggagagttggcggctgcgaacctctgataaaacgccggatccttatacaaattgatacagagaatgatcaaaattgcagcctgcggaattgggattcctccaaaggccgtgagcatctccggagccgggccgctcagagctgccttgattccttccagtcctcccacatcaaaaaacagctttggaaacgcggaggacacacaggtaaccatcaggaaaaagaatatcatatccgtaacagccacacccatgaggccgcccagacaggtaactccaatggagatagccactacaatagccgctaccatcaccttgtctgcatgccaggcaccttcacctacataccctacagccgcgatttctccaatggaaagacaagtgatcacaatgactatagcccccaacacagcggcaaattttccgtaatgtaccctcagaagatctggaattgtaccctttgcctttacagaaatcctgggtgccacccacagagcaaggggaaagcgcactgcatgggcaccgatagaccagataaagaatccggcaaaacccatggtggtggaatatccaactgtacccacaacacctgcaccgccataccaggacgccattaatgtgccgactaccagagaccagggcagagcccggtttgctttataaaaactgtccatatcctgtgatgtttttgaaaaataataacctaccagcagaataccgatgaaacagacaacaactactacgttatcaataatggtcatagaacaacctccctcttctttcgcttttcctttatcgcacagggcagacagccgtatgcgttctcatattacaggtcaaatccctccagagctttttcaagcacagctctctgcttttcggtgtactccggcgccgtgtattctttcaggcgtttttccactctttcttttgccttttgttccacggagactcttccgtttctctcccagtccgcataattttccaggctgtaaagctccggatagtagatttccgtgcggtaacgaaggatggtttcctcctctgccagataatttccgcccggtcccacttcctgaatggtctccagatccatatcttcctctgagaagatatcaatgctctccacagactttctggcagccatcatctgttcgtccagcacatatttctcaaagctgaagacattcaggccgtccatctccccgaaggagtggaaaataaagtctgcctttacatcaagactggtcataagggacatggccgtctccgctccattctggtaatccagttcttttcccatggacagggagcctccggttcggcagggcacgtggtagtaatctgccatagcctttgcatattggataaacagtgcctcctcacagccccaggataccggcatggcttttctcatgttggagacataggtggtgtttccatagactaccggtgcccccggattgacaagctgggtcataataacaccagcaagcacttccgcattgttctggacaatggttccgcccagtgtcaccggactggtcatacccgggatcgcacagcaggcgatcactaccggaagatttctctttgtgtaggcaagctgtccttctatatcatcctttgcatagcgcagaggtgagatgacatttcccacaccgatagtaaaatagccctcgtctgtatcataaaaatcacgggccagttgtatggtctcctctgcatccgtctttccaaaacaggacatgatgacaggatgcgtggaatacttcagagtaagcgctcccttgataacctctgccctctcttttgggaatgccggaacataggtcagaggtgagctggacagattgatcatgctgctggatgcgtccagtttacggatattcacatagtcttgcggagtgggatcatacacgttattatccctcagaattttccttgctcccgatgaagaactgatggcctgtcctccttctccgatcttcagttcctcaaaaggtgtcttcagtataaagctgggcggtactgtggacaacgcccgctccactgttttcctgtcaaaatatacacggtttccctctgtgcgtattccctgttttctgtaaagctccagaagctccgtgtgttcaaaatccacgcctacatgttccagcagatataaagttttttcatggattgtttccagttctgatcgtttaacttcatttattatcatatgccatcctccatctacagttttacaatggctcccacttcaatcttcatgccgccccacagttcaagggcaacgccgcatctggccggcggacattcggtgccgaaaaattctgcatatatttcattcatggcatcaaaatctttcatcgtggataagaacacatcgcatttcaccacatcctccagagaggctcccatttcctccaccagcagcttcagattgctgagagctgcccttgtctcctcctggatcgttccgtgaataatatcacctgtctcaggatccagggcaatctgtcctgaaacaaaagcaaatccccctgcaataactgcctcagccacgggtcccccgaataccttcattccttttggggtaaatacttctttcttcattttcgctgttactcctttccgtttttcgtcatctgagtgataactaatttgtaccaggaattcgtcggaaaaccgtctgctctcaaatattattcaaaaaaaagacacggagttttttccccgtgtctatcctcagctttccatactcttcagttcttcccataaaaatctgctgtccaatttctttgctatccggtcagccagctcccggcggtgttttgcctcttctgtatcaccttccgcttccgcgatcagcgcacagcacagctctgttttcgcctctccccacagagaaccggcctgaacaaaacaggaacgtgctttttcagcaaattttttcgctctactgctgtctcccatccggcacagtaccaggctcatatccgagtagaacacacctgcctccccggaaatcatgtatttttctccaatctccactgccttttccaggcacctgcaggccatatcccacttcttctggcgtatataacagattcccatgtcatgatgacaggccgacaattctatcctgtaacgctcagtttctctgtccgcatgactcagacggtccactgcctccataaaaagcttctctgccttttcatactctccgtccttcatcatacagatacccagataccggatcagcatacactcttcctccagatggcggcatgtacagtctttcataaattccatacaagtttcgatcacactgcgcataaagccgttttgtcctgtcagatccccatataagatgagctgcagataattataaaaaatatagtctctgtcctgaatctgcttcgccagttccagacttttctcaatacaatttttccctctctggcagtctctgacaaacatctcatagcgccccagcagatattccacccgcatgcgaatgggagtcatcttagaatctgtctcctgcagtgcccttatttcctccgccagctccacaagctcatcttcctttgccgaaaagccgtcgatattgccgctgaacacagcttttctggccaacatgggataaaaatcataggaaatcctgtagaacgcctccagatattccaccttataccagtacattttgtaccgatcccggcagcgctcatagtgataaatgaccagggagcagatgcccagattcctgtccttttggtattcctgttcataatatctggcaatgtagttatgataaatatcctttttttcttttggcagactgctgtatacatattcacggatgatctgatggcggaacccgtaatgcacctccccgctcatcagtttttcataaaggatctttttatccagcaaaggttccagtatctgcaaaagctgcagttcctccatgcccaggatctgattgatctctcctttggtcacaggaagagaaaaaatggatatgatatccagcataacgcgctcccgccttgaaaggcttaaaagcctgctctggataacattcgtcatgcggtccgtaaatgcggtgccatccccttttttctcaaacagccgcagagattccataaaaaacagaggatttccctgggtttttttataaatttcctccacaagccgcggatcgttcagaagacctgcgtctgtctcctctatcacccgcctggcctcctccagggtaaatggctttagttctatttctttcaggattccccgtccgatcagaggtatcttgaagctcttgatgtcatcaccgtcgtcctcccggctggcagccaccacaagcatctgcccatggcccatgcggaacagcagattgctcataagcctcatgctcatggaatccatccactgaatgtcatcaataaacagaagaattttcctgtctcggaaatattttgtcagatagcggaagaccgattctgtcaaaatttcaaaacgggtcataaaaaactgcacatccgaggcattctgccggagcagaatatcagtaggggactccacatccagtccgtttttcttacagtattcatccaccttagccatgattccatgccacggcatcagatacagatccttttccgtctcacagcatgtccaggtaaatatcagatagtctgagtcctccaccatccgccggatttcttccaggagcatacttttccccacaccaggctcccctgtaatcagaaaagaacggcagcgcctttccgaatctccctcttttgcgctgatccgcgaatagatgtcatagagaatatccgctcttccgaaaaaatattcgcctctttcttccgggggacgtttcagcctgtttttcatctctgaaattttctcataaagcgcctgtgtctcctcttccggctgttcctccacttccttttccaaaaatgttttcagagactgataaatctccatggcagggagatatcttcccgcctccgccagttttttcatgatacttcggtacaattcttcgtccagaacctcattctgtatgagtatcctactgctctcctccagaaaatcaagtccctgccctgtcttctgccccatgatcttaagctgcagtgcttttaaataggctcttttccgctctgccctctccccctcggcccatgcctcaaactcatagcagttcttcacaaagaaaaactggaggaattcgcccttccagctttccagcagattttcccttgtgatatgctccatgtcgatatcaatatccatttgacggttcagaacgatcagcgtgttaccctccacagtcaaaatgtcctgtcccaatacttttcttatattataaaccgcgtcccgcaggtttttcctggccgttgcctcgctgtttcccgcccacaaaacactgatcgcctggcttctggatatctggttattcacacacaaataataaaacaggccttccactttctgataggggaaagagactttttctccaaaaagcaatacaccgggccgtcctaaaagctgaacttctatgtcatgagaatatcttctatccatgttttcacctttacctattttccgtaagattacttcccgcttctcttctttaatgtaattgcactcttgggacagtttgcagaacagatggtacagccccagcatttttcagggtcaaacttcacatttcccccttggtctttataaaaagcaccgaaattacagattttcgtacatttcccgcattggacacacttactctcatcccacagcgtctcataatgggatgtgggataatgaagccttgttcccagtatcctggccattttcgtgggatagcagtacacgccgtcacagttgcacagcacattattttctcctgactgcatcagtccttttttgttgatcccactgatcagcttttttgtctcatccagagagagaatggttcccaattttctgtcataaggggtgttcggtccctttaccagcttattaatgcatacattcacgggcttttccgtacatctgcccatggctttacagttgcagggcaggatcaggatttcctctcccagagtgtccatcatgtcgtaagactcctgcagggtcaaatattgtgtctgatgcatgggtacgtctttacctgccgctatatcaagggcagcctgcgcagtgcggtccatatacaccttcaaatcccattcatttaaccggtccactgtctcctgtggaaattccccgtacgcttcaggttcatactgagcgaaatacggataacgggcatagaaatctgtcattctgtaaaagatttcgccgctgctgtccccctcacatttttccagtacatttctctgataactctcaaaaagcagcttccttacatcctctttcccactttctttcagcaggctgcagatttcctgttcagatacgggattgcttccgaacttaacggcaagctcagcctcatagtcacggtacatgggaactgcggcctcataaaattcttccggaaccgcccagacttccattgcttttctgtaaatttccttcatgcttatcccccaattttaaaaagatcatctgtaaataaagttatcgaaatcgtagcgccggattgtcgaaaaaatgtcggctgacgtcggttgggatttttactctattctacctgaaatccgtatttctgtctacagtgtagtccggtgcaggacagaaaagtgccggggaaaaacttttatagtctctccccggccttatcccattacttctcttcttttatttttgctttcttatcccagaactcacagtcatctcttccgataacctttgatgtaaacggtgtaccgtcatgttttttataatgcctggtggcccggaatacatatcttgctcctacatacacaataggaacattgaaatacacgatcagaatattccccaaatctgagaatgcccacagattcccaagctccagcccggctatattacagagaattccaaaggctgccacaaaaagcgcaatacaccggaccgtattaatgcagattttatctttcctgatcctgttggccgctatctcagaaaaactgatcattcccagcagacaggtaaaagcgaacaggcagaaacacagggtcaccagaaatgtcataacagcattcatagctgttccgggtgtgagtacggcaatggattccgtgaatttcggaagcttatccagagccgcccaggaatctgctccggctcctgtccagcagtgagccatgaccactacaaaaccggtcaatgtacagatgaccatagtatccaggaacacaccgatggaagcgatcataccctgctcacagggatgctttgcatctgcggctgcggctgacatggtaatggtaccctggccggcctcgttggacatcagccctctcttcacaccctgagccagaacagtgccgaatacaccgccgaaaaaggcatccggtctgaaagcaccggcaaacacggcctggaagaaatagggaatcgtcttaaagttcatcacgatcaaaaccaacaccactacaatgtataaaaccgccatggcaggcaccatcttatctgtccattttgtcacctttttgataccgccgaatgcaataacagccgtcaggataatgataccggcacccaccaggtaatagaagacagaatctgtggaaattgtagaatttgtcacgatctctgccatacgtcccactgatgatacaacattaaacccctgggccggaagacagcacagcgcgtaaagtatatacagcacagagagaaatactccaacccagaccttatttcccagcagctttcttccataaaaaggcagaccgcctacaaactccccttcttttttctccttgaatatctgcgccagaacgccctccatataggcaactgccatcccgaaaaaagcggacacccacatccagaacaaggcccccggcccgcccacggcaatagctccggtcacaccgataatatttccgggtcccacacgcatggccgaactcaaaaagaaggccgcaaggggtgaaatccctgtctccacagaacgtttctctgtcaggatcttaatagcctttttaaaatgtgtcacctgcataaatcccagtttaaagctgaaaaagatacctgatcccaaaagcagaattatggcaaacgaaaaactgccaagaatggggatgtctgcataccatgcaaagttcgtgggaaaatcccacaaaaaatcagacagaggtccgataaaaccaaagacactgttgattccttcaaatacagcttccatactttaccctcctaagttgtcggcaccacagaatcccttgataccaaataaaatgtgtgtgttctgtcaggcgcataaatccgttgttactacaagtatatggtatattttttgcactgtaaaccctttaagtgctcattttattacagttagtgctaatgttgttactgttcacaaatcactatcctgggaggcgtattcccctaagggatactgtggacagtgacctaatgtccggaattttcatgcatcaacaagttcttagcagacagcctcttcttacagcaccgatgctacggctttttttatgtcccttttgtgtttcattgacaatccggcttagacattgtaaaatatccatatattaacagaaaactatatacttatataataaggatatggtaaatattaacagatagcttttaccggcagcgcagtaaatgcacaggcctttgcagttgttacattcattcctaagttatacggaggtggatatctatgaaaatgtcaaaaaaaatcgcttggacagccacatttttcaccctgcttatactgggatattcaactgccaaacccgagcagcaggaagaatttgtacctatatcagagtataacgaaaaatactccggccaggatgaggatttcgtacctgtcacagagtataatgaaacgtattctgacccggaacaagaatttatccctatccaggaatgcaatgatagaatggcggaatatataaagagcttacaaagagagaagtaaccggatgcatctttattccaaacagaaagaaggctgatttttatactttatcagccttcttttttgttctgccatccgcagatttttatgcctttgtacctgtcaatgcgatcccctcaataaactgcttctggaagatcagataaattacgatcataggcaccatagccagcactgacccggccatcagattggggtaattcacagagaactgcccgcgcagcgttgacaatcccgaggagagtgtcagcatatccagttttgtattcacgatcagcggccacatcagatccgcataggcaaacaatgccgtgaatacggccagtgccgcgattgccgtctttgtgagcggaaacgcaatactcacaaaagtcctgaactgtccgcatccgtcgattcttgccgcttcgatcagatcatccggtattcccatgtatgtctgcctgagaaagaaagttccaaaggcactcacaagtcccggaaataccagagcaaagatggaatccgtttttccgatagcggagatcatctcatactggggaaggataaacacctgtgccggaaacataagctgtgacaccaccagcgcaaagcacagattcttcagaggaaaatgtacttttgcaaatgcgtaagctgccatggaagaaaatacaaccgcgcatatgacccggataaagatcatcatcagcgtattgtaatacagcttcaaaaacggaagactgttcgtcacctgtgtataggcagccgtattttcaaacgatgccgggaaaaatgtgggcggtaccaatgtggtctccggtacggatttaaaacttgtcaaaatcatccataaaaatggaaaaatcattattacactgccgagtatcagcacaagatatataaatatattggctttgctgatttttctgccctttctgcttgtttcagccatcacctgcaacctcctcctgcattacacatcgtaagtaacccattttttctgtccgataaactgaatgatcgttattgcagcgatcaagatcacacaccagacaaccagcgcagagccatatcccttattgttcttcacaaacgtctcctggtagaaattataaaggatcgtctccgcactgcggatcgcagggttcgtcttctcgatcatcatatagacaatgtcaaacactttcagggatgacatgacacgcatcatcaggacaaagaacagggtcggggagaccaggggaaccgtaatttttcgaaactgctggaatcccgtggcaccgtctatccttgcagcctcataataggttctggagatgctctgaagccctgacaaaagcaggatggcgtcatatcccacgctgctccagatggtcactatggcgcaggttaaaagcgctgtcttggggtctgcgatccagttgatgtccgaaggcagatgtaaggcgcttaagactgtattgataattccgtactctgaattaaacagccatttccagaccatagccaccgctgccggcgcaactaccatgggcagaaagtaaatggccctgaatactgtttttcccttgatcttctgatccagcaaaaccgctatgatgagaccaaagataacggtcaccggaactgtgagtaccatgaataccagtgtatttttcgtaatggtccagaaactggcgctctgaaacattttaatataattgtccagtcctacaaatgtccatttcccgaaggctcctgacttgaagaaactcatataaacagtccgaagcagcggataaatattcaagatgatcaatccgatgacggttggcatcaccataaaaaatcctgttgccgcgcctttgctgtattttgtctttgttttctgctgtcttgccacctcgtccacctctcattctcagtgttctgtagccaggctctcatccacttgctgctgacactgtttgcatgcatcctcaaaactcatatttccgctgtatacctcaagaagagttgcctctacctccgggaaccaggttgattttgtcttggaatagggatactgtacactgtactccaactggtctacataggcctgtacgttcttgccttcatagtttttggaccaggattctcctgtgccgttaaatgccggtatggctgcgccgttttccccgtggatgatggctgcctcctcagttcccaggaatttgaggacatcttttaccacatccaggttcgggttatctgctgctgtggagtatgcaagaccgttggaaatgctggcacgtccgtcacctttcaccggatccgggcatttcggcagcactgccacatcccagttcagatcaggataattgatatacagattgttgatgccccagcttccgaagtacatcatggcaccctctcccgcaaagaagcgctctgcctttccaaggtcggaaagctctgactggttcggtgagaaatcataggcaagctgccagtccatgtactcttttaatcccttttgtgtaccgggatcctcaaagcctgcttttgtcttatcctcatttacatagaatccgccggcctgatatatggtgttcagccatccctcctgctcattgtggtctgccatgatcccgtattttccggtcttgtcatggatcgtctgggatgcctccaccagcgtatcccatgtccaggtatcatcaggataagatacaccggcctcgtcaaaaatgtctttattatagaccagcgctactgtatccacatcttttggaacgccgtaaaccttgtcctcataggtgaagttctgaaccagattctcagcaaaattgttggtataatactcttttccctcatcatacagatccgtcagatctgccaggattcccgcttccgcgtatttgctgaactcatttgtgtgcatccagaaaatatcaggaagggaattgctgtttgccattgcctccagctttgtccagtattcactccatgtagatatctgcacatctatggtcacatttgggtgctgttcgtgataagcctttgccaatgcctccatacctgcctgctggtagatctcccagcccagcatggtgagcttcacttctttgtcggaagaggttccgcctgcatctgcctctgtccctttatccgtatttccctctgaactcccctttgaatcggagcctcctccggagccgcatccggccatcacagacgccagcatacatgctgttaaacctaatgcccaataacgttttttgtttctcataacttttcctcccatatgtcattgtttttttacatatttcattttctgttaaggaaatatgtctcatatatgatgtgtattattataacatttcgtcattttccacaaaacatcataagatggcattatgtgtacaatttgaatgtacaaagtagtattttgtatatacatgcgcgattttgatagtatatttaaatcacatcacctatttttcgcatttctctcttatttttttctactttacagttttcttttcagtctataaaataacaatgcaatacccactttggcaaaaatttcataacagttcagacagccggactgttgtaggcgttccccgtcaaagagcgcttggccacaggctgattctatctttactcaggaggcatacatatggaaagctatatctttaactttaatgagtgtcaggacttaaatttactggaaatcggtgaccagcagtgtacccctctatattcttttggtccgtacatcaggaatgaatatattttccattacgtgctttccggaaaagggtatatctcttatgcaccgtccacctgctctgacaataagatcctggcagaagtatcgggcagcattgagatcaatgcaggagaaggctttctgtttgagcctcacagcaagcatatttaccatgcggatgagaaagaaccatggcactatatatgggttcttttcaaagggttatgtgttccgcagtatctcagggcctgcgggcttaaccacggctccccggtctatcaccccaaggattacacagcccagaccaccaccagcataaaggagcatctgtcagcgatcctgcagcatccccatgcttccaaggcctttatcatagggcatctgcatctgttttttgataccctgatcaaaaatgccgccggctccatcaaatccggacatgccaatatccggatcgctgatctgtacatatcagaggcggtccggtacataggcgcagaatacgccggcatccgctccctggatgagatatccaattactgtaatgtgagcagaagccatctgaccaaattattccgcgccaatctgcatatgtccctgcaggaatacctgatccagtttcggatcaacaaatctctagatcttctggcaagtaccaatcttcctgtctatcagattgcttaccatgtgggatatgaaaatgaattgaactttctgagagcttttaaaaaacagatgggaatgtcgcccagtacatggcggaaacagaataagctttgatgaggaatctgtaaaaaacatacacaacaaaagagactcccggcaagccggcagtctcttttgtttattttaggaatgaattttgtggcctttattatttcagatcagtggtgtgcgtgatgctcttccaccactacgtctttgcatactctctcgatcatatcttcatctgcaaggtacggcatggtgatgtaatcctgcccttcccttatcttgttgtactcggctactgtctcgatggagtgctcgcatcttccccagctcctcctggataccccgatcatggtatcccacgggatcgctgcccgtaagatctcatccacacgctcgcttccgtccagcaccattccgaatcctccgttgatggatttgctgatgcctactccgcctccgttgtgcagcgcgatcaggctcattcccctggctgcgttcccggcataacactgtactgccatgtccgctgtgatattggagccgtcatagatgttggaggtctctctgtacggggaatccgttccgcctgtgtcatgatggtcacggcccagcatcactggtccgatctctccatttcttaccatttcattgaacctaagggcaatatcccttcttccaagggcatcctggtacaggatacggcactgggtgcccaccaccagtttgttcttctccgcgtcacggatccagatgtagttgtccctgtcctggctccttctgttcgggtcgatcacttccatggccgcatggtctgtggctcttaagtcctccggttttccggacaggcagcaccagcggaacgggccgtatccgtagtcgaacagctccggtcccaggatatcctccacataggacgggaacacgaatccctcactggtatcctccccgttcttggcgatatcctttgctcccgcgtcaaacacggcgcgcatgaaggagtttccgtagtcaaagaagtaggagcctctctccaccaatgtcttgatcaggtggtagtgtttgatcagggtctggtccaccagctcgcagaacttctctttgtcgttggccagcatctcggtgcgctcctcaaaggtcagtccctgcgggcagtaccctccgtcgtacggcacatggcagctagtctggtcagacagcagctcgatcttgatgttgttgtccaccgcgtactgcagcaggtccacgatatttccgtggtaggcaatggatacggtttctttcttctccatgtattcctctgccacacggaacgcctctgccgcgtcctcgatcaccaggctcacccagccctggctgtggcgggtctcgatacgggaagcatccacctctgcaacgattcccacgccccttgcgatctctatggctttcggctgtgcgccgctcatcccgccaaggccgctggtcacgaacagatggccggacaggtctccgtcctgaggcacgcccaggaacttacgtcctgcgttcaggatggtgttgaaggttccgtgcacgataccctgcggtccgatgtacatccagcctccggctgtcatctgtccataggaggagcagcccatagctgtggcctttgcccagtcctccgggttatcgaacatgcccaccatcaggccgttggtcacgatgacacgggggctggtcttgtgggatttgaacaggcccatgggatggccgctcatcatcaccagggtgtgctcatctgtgagttcctctaagtatctcttgatcaactggtactgcatccagttctggcagacctgaccggtctctccgtatgtaacaagctcatatgggtacagggccacatcatggtccaggttgttgtcgatcatgacctggaatgcttttccttccacacagtgtcctttatattcatcgatcggtcttccgtagatcctgtccttcggcataaaacggtatccgtagatacgtcctcttgtcagaagttcgtctaaaaattccggtgcgagctgttcgtgcagctcttccggcacatatctgagggcgttggccactgccagcttgatctcccttttgttcagggtcagctctctcttcggggctcttctgacaccctctttaaaggtagggtattccggcagtacgggatccagttttatcaccattgcttttccgatttccgtattgttcatcttttatcttctccttttcctgtttatttcatctgatctttacatagactttaccacacaggttgtcaagaaagcgtcgaagaagatgccaaaactattaaaattttgtgaattatccactatttttatctttatttcgtctaaaacatgtagtaaacaacaatttcaggcagctatgaagctcaaatatcttccagccactcgatctcataggcacccggtatttccttcagacatctctttgccgtttctttatagacatccaccggttctgtgagtatctccctgaaattttccggaaaacgcaccataagctctgcctctgtcaatgccagaagtccctttgcatagggggatgcaaactgatccgcgcttttttttgcatcctccagataccggaccgcctctgccttatttcccttttccgcctccaagaccgccagataccccttggttatggagcgtccgatcagggtaaaggactcctcatagacacgatctgcctgatagagagcatcctggctctgtctcgtctttcccatagccagataggatcgccccatattggaataaaatgtggcattgcagggacagtgattgctgtcacaggttgcgaccgcctcccggtaatacctgttcgcctcctgaaaatgcttctgttttctcagtatttctcccatgtaattgtaacatgctgcaatattcagggcatagatcctggatttcagcggcgcattcataaaaaattccagggattttttcaggtactccatgccctgctcaaatcttcccttcatggtcagatacagcccatagaggcggcaggttatggcatagtcctcagacagtccgtttttttccgacagtagaaggctttcttccagatactcttctgtgtgttccatctcccacagattgatctgctggtatatgagaaaacgcagacatctgatcttctctttcgggtcatcccctgtaaggacattggactttaaagccttttcaatacactgggcgccttccctgtagtacccctgaggaatacagtattgggccgtagcctgcatgagacttacatgcagtttcagatacgactccttttgaggatttctccggcacagctccaaaagctcttcctcaagctgtctgcagtaatccagcacggaatccatctgcacttcttttttcccggcagcagggaagagaggatacagttcataatacctgtaagagtattctgtcagcgcctttatcctgtactccagggccttctccctgtccccgcacaaggtatagtggtagatcaatctttcatatctgtttgcctcataaaagggcagcccttcaatgtattccgccagttttctgtgaaatacacggcgctttgaaggtgacattttagtatgtacaaatttctggatactgtcatggcagaaaaagaaccgcacggtctcatcatcctgctgctctctgataaatccctgctccttcagttcgtccacagcatccaggatctccatctcatcacatttcaggatctgcatacaggcatccatatccgcccatgcctggcaggaggatatgagttccagtacctgcctggtctttttctgcagcgcggccattttctgctcccagacctgattcagaggtgtaatatccccggcctccagtcttccgtccccgcagcagtccaaaagcgtcttcagatacagggcatttcctgatgtttcactgtaaacggtatccaacagctcctcgctgacccgctcctcccccagtctcccggccaggatctttctcacggcttccctggtaaatgggaacaaggtgatctcctgcaaacagctttccttcaaaagaggcttgagcgccgtccgcaaaggctgggtaaaaatgcatgggctggtgaccaataccataatattgggattctttgcacgcatgagcagggagagaaactccaggcttgtctcatccatatattgtatattgtcaaaaaagagtaccaccagcgcctgttcgccaatctcttcaaacaattttatcagcagatttctggttgcccggtagctgtaggatatggtggtgtcacccatgacaggttccttcacatctccggtattaaaaagcgggaataaaagctctgctgcctgcagatattttttctccagggcaaaatcatgctttttcaacagggagttcacctgcatcattatggtgttccatggctgcagcacaatattctgctcattctccagacaggctgcccgcagaacaactgtattttcccctgtgatctcctccagaaaccgttccgccaggtaagttttccccacaccgcttttgccggagagcagaactgaggttggagtgcctgacaaaaactgccggtaagaagcctggagaagctgaagttcacattcccgccctgtacagacttctcctgaattttcctcctccttctccccttcctctgaccagacatggagaagcttcctgtaaagctcccgtatttccctgcggggcgctaccctaagctctgtattcagcagattcacgagctgctggtacaggcggattcccttgtaatacagatgcgcgctttcataaatctccatcatgcgcagatatacccgttcatctaaagggtcctcctgcacatagcgctcaaacaaggtctccccttccgcaacactcagacctgcattgttctgcattttctcatagatagctctcaaaaacgcctcttttgcaagccctcttttcattgtcagccactcttcataggggtacgcgttcttgatatagaaccctcccagaagctcctcccggtaaagctccggttctctgttttccatgaacgcatcgtaatccacaagaaaggtaagctcagggttcagctccagcgtctgccttgtcggtgaggagacaagatctgtatgaaatattttacggatggtgtacagagcgtgccgcaaattcttcttggcggtcgcctcatcacaggaatcccacagaagagctgcgatctgatcccttgtggcttttttctcaatggccatatagtacagaagcgcctctgcctttttataaggcagaaggatctgttctccatccagtaaaatctgcggtgtctgtaacacatatatctgaactgttgacacaatttttctcctttccgaaaaagctgccttctctgcactccattttatacaaaatcctacataaagtaaagcataaaggccgctgctttggaaattctccaaagcagcggccatactgccagaaacttttattctgctgtctttactttacagatacccagttttgcggcggtatcacctgtacactgcacatcaagcgcttcctcccagttttcacacaggagcagttcgccttcttttaccatatgttccgaaacgcagatgcatccctctcccacatagactgccagcaggtcaaacacttcctcaggctccagtacacaggactctccggcctctaatatggccgcctccattctgccgtctgcgccgtttttcagcatcaggttaaagtctgtcacttttccgtagctgactgtgggcactcctccatcgaagcagtcaacctcatatggctccaattccgccttggtgttgacaccgtggatcatatccagatgtcctttcagtgtcatcagataacgtttgacaccgggcagacttgtgaagctggattttaaaagctccactgtggcactgctgatgcgtacctggaagctccctgctttgtaatctccatcctccggatagataaagagctgtgttgtggttcctcctgaccagacagaagtctgatactgttcagcgtttcttacagtgatactggcactcatgacgtttttcccctttctttgcctgcggtccggggtctttacagaattccctcttccgaaacaggcttcttaaaagcaccatccagccccatgaaatggaaagggcaggaaatgctgataaaataatcccttttacgggagatatctctgtaaatgtaaccggtccgaaaaacatcacaaataccactaccatcatgatcaccagagtgatcttctccctcatggtgttcggcggagtcaaaaatatcttctggagatccatctccactttttccggttcttttctcatacgctcactactcctaagtcttgtgcagatacccggacccatctccgggtatctctatatattaaactatacttcaaaaatctgtttctgtaaagcagcagtaaaaaatcaatgctactgtgttactgtgcctccagtacctgaggctccacatctaccacatcatccacgtcttcgatgatcttatccacaaagaacaccttaaaggtggatgccagttgcagcaggaatataggcagtacgcagaatcctcctacaccggacaggtatttcacaccttccacaccctgctggcctccgccgaagataaccatgataacggagataataccgatagatacaccccacacgatcttctgccagtttgcaggctcttcgtcatagctggaaccctgggtacagatctgggagatcgtggtggacatggtatccgccgtggttgaaaacgccgctatcattgtgatcatgatcagaggaatgaggataaagctgagcggcatcttctccagaagttcccacagtcctgacaccgcaatgccgttctttatggctccgatcagatccgcctttccgatatcctgccagttaagtgcagttccgctccatacagagaaccagataagaccaaaggtggacggcatgatccagtttacgatcatgaactgacggatggttcttccgtaagagatcattgcgaagaagattgccatcagcggagcatacgcgatccagcaggcccagtcaaacatggtccaccaggtaaccagtgcctccccgcctacgatgccggggtcaagtccccaggacataaagtggtcgccccagtatccgataccggtgttcatcatgttcagtatgtacactgtcggtcctgcgatcagcagaaataccagcagcacatagaagatcttggacgttccgtttgccagccatttaatacctttgtcaagaccggccacagatgcaatggtaaaggtagccgttatgatggcgaacagggtaaaccacacaaccggtccctgcttaatgccgtaagctgcttccaggccggagccgatcagcgcaagtcccatacccagattactggaaagtcccagggcaagggctacgatagaaaccacgtcgatgatgcttctccacacgccatatttgactttctgtccaaacagaggtgtcagggaagctgccacagacagttcttcctttttattgaaataaatataagccattgcacatccaacgatggagtacattgcataggggataaaggtccagttgtagaacacacgtcccataccgaacatggcagcctcctgggtcagcggctcaatgccgtaacctcccagttccccgtaaatactgccgtagtaaatcataacctcattggcaccgtacacgatacatcctgtagcgataccgcctgtcagtgtcatggcgaaccatgaaccgaaggagtgttttgctttcgcattgcgcccgccaaatctgaccttgcccagttttgaaaatgtcaggatcataaccacgacaagacagaagatagctaccaactgatataaccatccaaaactcttcagggaccatccgaaaatagcagaacaaaccttggtcagccagtcatttttcaggattcccaaaagtgcgccgccgccgatgatggcgaatgccgggataaatacactccaccggacacctttttgttgtttcttttctccactcatagaatacctcctggtaattttatttttcccgcagccgccccgtgtgcctgacggagcagccgctatgtaatgcggaccggtccttccgctttactgcatcttttcccaaaattcccgttgctttcttcctatatcctttacgccttataggatttcaggaactcgtatgttttctggatatccactgacatattcctgtcattgtccagatagggaaccttttttctgtaggcttcaaacagaggctttgtcccctctccaagctgcggaatctcccttagatccactgcctgggccgcatgcatcagttcaatggccgccatgtaatacagattgtcaatgattttccgcatatttgaagctgccatggtagagttgctggctgtatcctcaatgtggcctgccatactcaggaaatcaagagagcagggatttgcgtacatgcggttctctgtatccagataagacactgtcttctggatggtcccgtaggcgatgacagccccctcagcaggcgtcagaaaacggttcagcttcgtaaatcccggatcaccgatcctgagaatctgctgggaaatcatttttgacatatgagccagtcctgtgctggccatttccacagccaggacccaggtcagcggctcgaagttgggacttccgcacattctgtcctcctcagggagaaggcagggattgtcatccgtggcatttaactccacgccgagctgctgcttcagataggccagcgcgtccatcacagaacctgtgatcgcgctctggcaccggaaactcaaaggatcctgaagtgctctgccctcccagggcttttccagataactgccctttaaaagctctttgcattttcttgctgactccatctggccctgatagccccgttcccggttcacgctttcgtccatgggatccagcacaccgttcagtccctcaagggccaggcagaatactctcctgtagcgctcaataaactgttccgcctcaatgactcccatggctgcgaaagcagctccctgggcgttggaggagacaatgcccaggccgtcctttggtcccagcttcagaggttcaaggccggataactccagagcttttgcactttccatgcgctgattctggtaataggcctccccttccccgatggctgtcagaccgatagccggaagagttgctatatcagcttcccccacacttccccggctctttatgaccggatggacacctctgtttaaaaattccacataatactgcacaatctccggggccacccctgtatgcccgcagagaaatccatttagccggacagccataatggtcctggtctccggaatgctgcactcgggacctacgccgatcatgtggcttctcagcagatttttattgtacgcgtcatatcggtctgcatataccaccttatccttattccagcccacgcctgtattcaggccatagactgcaacaccgcgcttgtccagctcgaaaatcagttccctggctttctgtactctggtcatagcttctgcatccacttccacttttgcattttcaaatgcaatttccttgatctgggaaatcgtcagctcacttccggtcagccgaattaccttctcctgcatgttaattgccctccttacgtttctcttccagatatgccactaccttctccggtgtgatgggatagcttgcgaaactgctgcccagcgcatagttgacagcatttgccactgccggcgccggcgctaccgccgcaatctcacccaggctttttcctccgtacggaccgtccggttccccgtcctccacaaagatggagcgcaccttgggcatatccggcgcgttgatgatgtgatacttggagaagtttttggtctttacccttccctttgcatcataggaaatctcttcaaacaaggcctgcccaagactcatctgggcaccgccctccacctggccttccgagagtgtccggttcatgacctggcccacatcatgtacgcagagcagatccagcacctccgtctggcctgtgtacttatccacccgtacctctgcaaaagcacagcagtaggttcccggattggacggcggctcatattcaagctccgtgtgcatataacggcagcaccgcagttcataatcaagcgctacttgtttatatgacttctcctcctcttcaaagcgaaggatgccgtcattggccgttatcttatctttatcccagtgatacatctgtacacatgcatttttcatcttgtccagtagctgttcccctgccttctgtacagcgcgtccgcacacataggtcacgcggctggcctgtgttccagcggcatcatagggagtgatgaaggtatcagcttcatgtactttgatgcggtatacatccacatgcagggcttctgctgcgatctgctgcatggtcataaccgttccacatccctgttcgtgaatacctatctgtacctccacagaaccatctgaatgcacagtcattctcacatttgtaaattccggatacgcacctttataaccgtttccatgggcaccacatgccatacccactccataggcatagcgctttgtgtccttttcacggatgtgctctcttttttctttccaggaaaatgcctccattcctttgcggatgcattcctctatccgggcatttcccagattagtgcctcctgtgggatcctcatccatgggatgaaccacatttttcagccggaattcacaggggtccatccctatggcattggccgtctggtccagattcacctctgtgacagcgtgagcctgaggggagccatatccccggcaggcaccgccggatatggtatttgtataaaatgtgcgcacatggcatgtctggttttccactctgtacatacggaacaattttttgcagtatgccatggcaacagaagatgcgttggtataataagcacctccgtcaaaatctgtgtctatccttctccctcggatgataccatctctggtaacagccgtctccacacaggtctcggatgcatttctgcttcttgtccccatcaccgcgtcctgtctgtccatatacagcatgaccgggcgttttaagatccaggtggcaaacgcacatgccggttctaccacagtctggccttttcctccgaaagaacctcccatcacagctttgatcacacgcactttagaataagaaatccccaaaagatggctgatgtggtatctcacctggtaaactgtctggcatggagtccagagcaccagattgccgttctcatctatttcgctcaacgcaatatgcggctcaatggcactgtgatggatcttctgtgtactgccattggtgcgcaccactgtcagttcctctttgctctcctctgcgagagccccataatcaccacagttcacttctttttcaaaggccagcattccttccgtctttctcgccgcatcaaggccgatgacaggagcctcctccttataagtgatctccacaaggctcacggcctcctccactgcggctttcgtctctccaaccaccagtgccaggtgatctcccacatatctggccctttcactgaggatatactgatccagaggaaactccaggcaagctgaccaattgtggggattgtatgtgatcttcggcacattggcgtgcgtaaaaacagcatgtattccaggtacccggctggccttctctatactgatgctgatctcggcattggccttttcactcagaacgagctttgcatagagcatgcctgcgatctgccggtcgcaggtgtactgggtctttcccctggctttgtcataggcgtcctcgcggatataactcttgcccacatattttaaatcacttttttttgtctccgtcatctgcccgcctcctcttctgccctgcgaaggtcatcgagaatctgatcgacaaccccgaaagcggctgattttttataatgctttgacggcctgtcgggtatgttttcctcaatctgggcatacacggcatcccgcaccttttcctcatcacagcctgaaagacttaaaccctccagacacacctcgatcagacgggctctgctggctttcgcgcctacggctcccaggtacacaacaggatgcaccatgcagccttcttttatctctgcgcagatacagccgttgatcttagatatggtaactgcttttctggtacctacctttgcaaatcccgacagtacattctgtttcctaactaaaaacttcaggataacttcccgttctcccagactggtcttctcaagcccttccacaaaatcgtctaccagacgtatggtctcagcaccgctttcatccaggatttcagcttctgcgccataggccagcagtaccggtgtggtatctgagctttgggaggcgttggccacatttcctccaagtgttgccctgttccggatctgggtggagcctaccatggaggcagcttttgcaagagccggcatccattttctgataacagggctttgttccagctccgtcatggtgacgcccgcgccgatcagcacatggtcttctgtctctgtgatcttggacagctctggcagatgcgtcagatcgatcagagaataatggaaatttttatcttttcttaagtggatgaccaggtctgttccccctgcacagagataagtatttttatctttttccctaagagcagcggccagttcatccaaattttgcggcatttggaaactcacttgatctccccctctcccacggcgttcacagccttcacgattttttcatatcctgtacagcggcacaggtttccctcgatagctctctttatctcctccacggtgggatggggattttcatagagcagtgccttacaggacaatatcatgcccggcgtgcagaatccgcactgaacggctcccatttggataaatgctttctgcagcgcgtccaattctccgttctgttccaggccctcaatggtggtgatctcccggtccatgacctggcctgcgaaaactgtacagcttgtcaccgcctttttatccagcagcactgtacaggcaccacactctccctcactgcatccctctttcacacctgtcagtccgcagtcctcacgcagaaaatcgagcagacgttttgtcggctctgtgtctttctctacctgttttccgttaatcatacatctgagcagcattctattcaccctctcctgcttttttcttatatttccaacacctctttgtgcgtttttcagtctgttctatgtctgatgagactattgtatatcatttccgttgaaaaaccgttgaaattcttctggttttttgtctaatttccaagaatctcttgacggaagacgttttttcttaaataatgggtaacagacaggaggattaactatggaactggcaaacagctacctggaggagggttttccctttcagggacgaaaacgaaaaaaaatggaagagtttctggaaaaaagcggcctgacctatgacccacagatcatctactctgttcttctgtgccgggaagacggagagatcataggctgcggttccagacatgaaaatattttaaaatgcattgctgtggatgaagcttaccagggcgaggggcttctgcagaggatagtcacacagcttatcaaacaggcttatacttgcagtatcccgcacctgtttttatttaccaaaccggaataccggactgtttttacagatatgggattttacactataacgggtacggattccatgcttctgctggaaaacaggaaggacggtatctcccgttatctggagcaggaacttgcccggcaccctctcccctccaaagaagacgccggggccattgtcatgaacgccaaccccttcacctgcggccaccgctatctgacggaaacagcagcccgggtgtgcagcgtattgcatgtctttgtcctctccgctgacgcctcggaatttcccgcagacgtaaggctccgccttgtggaggagggctgcagggatctaaaaaatgtggtggtccacggcagttccgagtatctcatatcccatgccacctttcccgactatttcctgaaagataaagccggggcgtcggacagggccgcggaactggatctgaagatttttgctaatcatttcagggatgcctttcatattacgaagcgttttgtgggcgaggagcctttttctctggtcaccagagcatataatgaacagatgaagcgaacccttccggcttgtggcatcgaagtggtggagataccccggaagacagcaggcgataccgtcatcagtgcaacctatgtgcgcgaaaaattcctaaaaggagactgggacgccctgcgcccgctggtgcctgataccacctaccgttatctggtatcagaggcgggaaccgcacttagaaaacaattattggagagacagtcatgaaccatacagacttatgcacaggcactgccattaccctgcagcaggtgttagatgccagggaacagcgggcagccgtgcaaaacgaaatgttaaaagacctgcacagtgaccatgccgcccttatcagctttacactgaatattgtgggaccggtcaaagtctttccctatacgatcctggcctacgaggcaggcctggaagccatacgggaatgtctcatgtggctggaagcagatatcacagatttccgggaagtccgggagaacacgggttatgaagctttcttttctataaaaaaggaaacgggaattgcggatatctgtaaagaacatctaatagaactggaggaaacacatcctgttggccgtctgtttgacattgatgtgcttcggtctgacggcactaaggtgtccaggcaatccctgggttatatgggacgcacctgccttctctgtgataagccggcttttctgtgcggacgctcccgcaggcacacagcccaggaactggtggaacgggaaacagccctcatcagagatttttttgtggaacgtttttccgtccatgtgggactgttgatgcagaaggcacttttttatgaggtaaatacaactttgaaaccgggacttgtggaccttgtgcataatggcgcccacacagatatggaccggcataccttccgggacagtgcctatgctcttacttcttattttattgagaccacccggcggggtatggaattcgccctggaaggaaaaaaggaggaggatctgcccgctctttttacctctctgcgcccgctgggtatggctgctgaggtggctatgagacaggcaacaggtggggtcaacacccataagggtatgattttttccgggggaatcctctgctgcgcccttggctatgatatggtttccagagacggcatcggctccttccgcctgaaatacacaaatccggcagaagcatttccccatttaaaaggtactgtgcagcgcatgctgccttatcttctggaggactatcagacccttcctgccggagaagctgcaagccacggagaacgtctgtatatacagtatggcatcaccggaatccgcggggaggcacatcttggatttccctctctctttcacatggggtatcccctttttatccgcatgctgtctcaggggtactccctaaatgaagcgggatgtatcgtgctcctgcactatatagcgtacacagaggactccaatctcatcatccgctccggctatgatactgcagcacgaatccggtctgaactaaaaaactttctggaaaaggctccctacagcgaacaactggctatacttcccagactggataaccatttcgtacagaaccatataagtccgggcggaagcgcggatatgctggcactcacttatttcttatattttataagcacactgccctgtaaatgggattagagagctgtgcggaaaggaaacagcgatggaatttaacatcagaaaagcagactacagtgacattcctgccattatgcaggtcatggcagacgcacagaaagctatggaacacccggaatggttctgttccgactgtgaggaatacatgaaaaaacacattgacgcgtacggctttactattatcgcagaagccctcccaaagtcctccccggcaggttttttccttataaaattcccgggtcttacagaggaaaaccttgggtacttactcgactattcagaggatgaactgctgatgaccgttcacatggacatggctgtcgtacatcccgcttaccagggaaaccggctccaggcccgtatgctccaaaaggcagaggaggtgctttccgattcccctgttttgaggaaccggcttctggccaccgtgcatcctgacaaccgctacagtctgaacaatatgctgaacaacggctataagatcgtaaaaaccaccagcctttacggcggcctgccaaggcatgtgcttcagaaaatattataatatttatttttattccggttttgttataatttatcactttcttcgcagactatatgcatggaggtgattacagtggaaaacgattatcaggtagcttctatctcagaagactgtgtctcagaaatcaatgagcttcagaacaaattaaataaagaaactgacaaggatattgtacttattgcttatcagtcaaaggcagacgaataggattgctgtgtcagaaggggcttttttgccccttctgttttgatgtcaggcttctccctttcccatccgggaatccgaagatatgaggcggctgcgcccttctgccttgaccagcttttccagttccttcaaggcatccttccctatccatttctgagctttgtttccattttccatgaggtcgtgcgccaacagtacagccttctcctgatagtcaaaatctctttttccaatctctcttaatgcccatgatactgatttctttacatgttccctctcgtcatcggaatatgtacggataagtgtaagataatggtccagtgcttccttttgcaaattcttttcgtgaatagccgcagaagccataagcgtgaacgcagctcgtttcatatacgttgcctccgcgtcacaccatttttctataagatcctcatatccttttagcttgataagaagattcttacagagatggtcgcacagatcccaggagatgacatcgtgcataaatgcttctgcctcctgcagtgaaaactgttttttatcaacgatcaaaacggcaagcagcctggcctcgtgatatcctgtattccacaaatcatgagccagggcattatctttgcccactgtcttggcaagttttctcacatcccctgtagacacgccgatactgcacgcctccggaatgcctagtttcaccacattgactttgtatttttctgagctgagcgcttttaatcctgacaggatttcattgcttgtcataatgtatttccccctttgctctgtacgctatcggcagccttcaactgagatgttcataactgccgcaaacttttctttcactataactgtagcctgcccaccggaatcactgccttcggtttctccaaatgttcctgcaaaaatttttccatccataccacatcacgccattgcccgtctttatagccgcattttgaaaaatgtcccacgatccggtatcccattttttcatgaaatccgatactctccggattgggatatgtgatacatgcattggcattcgttatattctgttttctcaaaatatcctccaatgctgtatagagctgacggcctatgccttttcccttggcattttctttcagataaaccgttgtctccacagcccagtcataagccggcctccctttaaaaggggatgcgtatgcatagccaacgatttcgccgttctgctctgcggccaggtatgggtatttcttcaaagtttccctgatcctttttgtaaattcctcctgagaaggcacctggtattcaaaagtgatacaggtattttccacatacggttcatagattccaagaagtgtaaaagcatcatccggttctgccattctgatgcgcagatcatttgcatttttattcatagactttccatttccctttcccatttttttcttcgtcggcttgaggatatattgtcctgctgtattttatctaactaaaggaatcccctcggtatatggtccttttttcatctgtttcgttaaaagcattccgcatataaaactgtcttgcctttttattgcaggctaaagtccatagagatatttcacgcttttccaattcccttgccttgttcactgcaaaatccacagccgtagtacctgcccctgaatttctaaaagattctataatataaagactttctatctccatacagctttcactgactgtcgataggatcagaatcccgattggcgtttcccctttgaaaaccagataatcaaaagaatcatcctcatgcattcttcctaaaaattcttttttttctgacctcaacagattgagacaacaggtatgcctcatcaaaaatccctctataggactgctgccaggctgttgcatggatatacgccgctgtttctatatccgaagcctccgcttttctcaacacaattcctttcttaaaaccatgggacatcatattcttcaacctccctgcatccggattcacagaataaccgacagcagtgtctgcattttcacgatactttttatacataacagacaactgctgtatagagctgtcggcctatgccttttctttcccttctatgagcaaacgcggcgtatgatatttcagaaattctgccaattccacagaatctttaaccttttgctccaatataataccgccgaagcccaagttatccatagtgtggaaatcgctgccggatatccgtctcaaatcaggatagtcacagatccacttttccagaagttcattccggttctcaccattatgccgctggttaaactccactccatccagatattcaggattttgcggtctgcatggcggtcggaacggatgtgcctgatacaggaccgccccattttcatggcataatgcatacagctccttttgggacagaaaacacagattgggatgtgcaaacagaaaatcccggtctatcccatagataagaaaatcttctgcataaggttccaggcgtatttcgattcccagtattacagtaaaaccacattccataccggtatcatacgctttgtcgtaccctaaaagatatctttctatgcgctggcggtccgtactaccaaaatcctttaaaaggtcattgtcaaaatgatccgttatcacaataccgtcataatcggtacggctgtacgcctttaccacttccctcgcagaaatctgtgcacatggactgctttcagatgtgtgagcgtgcatttccagtttcatagtgttacctgtcttattaataccatgggacatcatattcttcaaccttccctgcatccagattcacagaataaccagcagcagtgtctgctttttcatgatactttttatacatgacaaacagcagagagtccccgtcatctgaaaccctgtcatacactaccgttacctcataaggcctgtctgcctcattttcatattcggcagtatcacctcccaatacagcgtagaaattcccctttgcattatacattttttctgatgttgtatactgcttcgagagttcattctcatacaggaaatcataagagctttccatcctgctgaaataatcctgattttccttatctgtgtcttccctgatctgttccatcatttcgctttcctcaagggaatccaacagttcattgtaagtctgctccaaagttttctctgtatgatccgcattcgtataataagctctgtccctttccacctgatcagattcccctgcaccgccaaaagccaggctgcataaccttacactgcctttcacttctatctctacctgcaaagccccggtgaatttttcaaatatagggtcttctatggcatcggctatcatcccggcagcctctttggaagcctgtctcatctccgcctcactattcacaataagacgatatcctgtaatcccgttctcttcctcctcactccacttggtgcaaaatcctttttcctcatacgtctttttaaaataatacgcctgaatattatctataaaatcatctgaaagttcgctgccggaaccgataggatatctgagaatgtggacagctatatccggatatttttcgttcctgtatgcccctgaactcttttcaaaatccattccatatttatcttccagcagtctgatatccctctcttcatcccactcaaactttttcctgccaaagaaagatatcttatcccaatatgtataatctgacgtatatccccctgactgctccgccacacaaatcatattcaagccgatatcatactctgtgggagaagtgaacagaaagtaaaaaaagccggccaaaaacacgatcaccgccacaacagcataaatgacagtcaccaccacagccagcactttatacttaatcctggtcagataatatccgatcagcagagccggaaaaagaaaagccaaaacccaaaacagggcctgcacccatatcctgaactcaactccaatcccctgcagaataaattttgcaaggccaaatcccattaagcttccgagataaatgatccagggaagcacatactttgtcttacgttccatactgtctcctatccgaaaaatacggtttccaaagtaccataccccatgccgttttggattctgacggcatattcatgacacagtctgtcaaaataaggaatccattcctgtctaccggatttttcagccagaacccgcagcagcattttcagttttccctctgttctctgcagatcatcacctgaaaaatactgtttcactgcgtccatatcttgactacagagcgaaagctctgaaagacgcctgtcagcgatcatacatccaaatgctgtcaccagcaccatctcgctgatatttcccatgtatgcagtgccgatccggctctgtatccgccccagcagctgcctcacagcctgttggggaaaacattccaaaaatcctttctccaatactatatcacataaatattgataaatgatatctattccgcacatttctccgctgaaattcacagtcggataatccagtgtcagcaaatgatcctgtggtctgaatctggcatcgtaaaagataaaaaacgaaggcattccttccaggacagtagccctgtaattgctgcagccataatcacagaaatctctgctcagtttgtcatagatagctttggccttatgcaccttttccactaccctgtcataaccgatcttatacgcgtcttccgctttcactgcctgttttcccattaatgcattagacaaaatatcgccgcactccttcacgcaatagatcactgcttccatcagcatctgtgccgtatcataagtcacagagctgctttccttggaggtatatttctctgcaagccatgccgttataggaagcaattcctctaattgatattccatttgccatttcccctttctgtcacagatgccaacactcctctactcccagaacaactctttcagaacagactgataaagctctgcgtcccaccgtgtctcctcactaaattcttcatactcatctgcgcccccgctctttgtgaatccgcgataccctcccctgacagcctttgaaaaacgttccagacatgtattttccagataatccaaatccccgtaacacacggattcatactgctgcctcataaatgtcagcagctcatcatctgtcagcttatcctgggattcatttttaaaatgataaaagatatcctgcagtctggtcaggactgccagatagttctccctgctgatatactgggaatcacagaagctatagacaagtttatccagaatccctttgccaaattctacccttccgtactttttcaggctttcatcccggctcacgatcaacgcttttgcctcctccttagtgagtgccaatccgaacatttccgtcttttgattgtacgcgtccagcattgccagttcatccttctgccgattcttagtcaacagttcaaaaatctgtttttccatggaccatccacctgttctttctaaaatcattttaccggtttctacagctattccatctctgcattcacattgtcacattccctgtacctgtgaattgtaacgctcattatacagccccagtatttccattacaagccttgaaaaaagcccctttttgtggtaatataatagtgaaaaaggaagcagaaaataaatatctgcttcctttttgtcacttctttattctattcttttgcctttaacgcctccaccatatttatatgcggaatcttccgcgatactgccagactgatcaaccaggagagtgccaaagtcccggctgcgctgaaaatccaggacattccttttataaatatgggcacatccatagactccggtatggttgacagcatatatatcaggagtccatatccggcgggaagtccaagcaggatacctgcagcggaaagccacacgttctgttccaccatgacactgcgtattttcatatcggcaaatcccagaaccttcatagtggcgaactcccggccgcgctccagataagacagcacacccaggttatacagcatgacacctcccaggatcacggcacccaataccagcagggcgatcatcatgatcatcccctccatcatggcgtctatcccctttgtcagatcactttgatgggtaatactgctctccttttcataacctgcgaatccccgggccggttcctttccgatgatcccggtgggcacaaagacgccctgttctttttcaaaagaacttttcatgatcgtaattccctggctgagaggggtgcggatgactgcctccactttcgagtccctccattccttttccccggcctgtttccaggtcactgtatcccctgttttcaggcccatactgtcagcggttttctttgaaagagctatgccgtcaccaatccccacaaaatcatccaggctgcccgccagttttatatattttgtactctccgggaccgtaaggctgacctccttttcttttttgccatcctttataaccgcggatgtctccatcaaatactccccctccgtacgcgaaagcaataccctttgcccttctgtatccggcagatttgtaattttacactcatagccctgctgttttgtgaaagtccattcagacaggttctgaaaggtatcaaacagcgcaaaagcgcagaacagcagcgctgtacatcccaaaataccgcacagggtcataaagctgcgcagccggtttctctccacatcacgaagattacagcggctggaaaagggaaggtgtctgcatatttcaggcagagagaccgtccttcttccgctttcctccctgtaaagacattcggatgcatttcctttcagatattttctgcatatgaccagactgactgtaatacaaaaaaggacacagataaccggcagcagcagataaaccggcggaagatatccgccccattccggcagcacatatatttctttcataaacggatagatgattcccggcatcactctgcagcccagaatacagcctgcaagggcaccacagaagcatatgataccgctgtgggacaggtaatggatcaacagttttagtctgctaaagccaaatgcctttaggattccaatctgtgttctctgattcctcagcatcctgtgcattgtggtcatgacgatcatcactgcgatcattaaaaacgcggaggaaaatgcagaaccaatggttttatgctgtttgatctcgtcctgtaccatggaaactgtgggatgtttttccgcctccagcactgtcagatccggattttcaagtatttcccgcagcagttttgtgctctgtttttcttttgttttaacagcagcctgatttacagaataaagttcctcagacggcagaagccggggacttatccatgcaaatccgtaaagtctgtgctcaggcatcatgctgccgttccggactccatagatgtattccggactgtctgccagacctgctatctctcctgtgatctccaaaccttgataggtaagagtcagtctgtctccgacctttagattattttcttccgcaaatgacgcgtccagccaaataccttttttactactgtcaaagggtatcccctctcttatatacagctttgatattctgttgtcttttgcaaaaatacagtcgagagaggcgtcttcttgtccctgtattcccatgggaactgccattcttccctccgcttctgtcactctggtatcctgttccagcttctccagttcttcttttgtaaaagctgtatcatatgcccagacatccgccagattctgcgaccggatatagtcctcaaaatgctttttaagtccgccccactctcccgtaatacccgaatacagaaaacatccgaagaacatcatgagaaagacagcggcaaactgcactttattttttctgatatctcgcagcatctttctaacaagtatcaccattccacctcttccacactgcacggatcatcgcagcattctatgctttttatctctccgctcctgatatgtatcactctgtcagccgcccttgcaatatttgcattatgagtgaccacaagcacagttttcccctctgacctgcacaatttctgcagctctgaaagaaccatgcagccagtctctgaatccagtgccccggtgggttcgtcgcagagaaggatatccgggttttttgcgatagctcttgcgatagataccctctgctgctctcctccggaaagctgttccggaaactttttttcatgcccgctaagtccaactttccgaagtgcctcaccggcttcaagcgcatcttttttcagttcacgcataagctccacattttccttcactgtcagggttgggatcaaattataaaactgaaagacaaatccaaccctcttagcccggtattttgaaagttctttttcagacagctttgcgatatcctccccggcaaccagtatctccccctcatctgcccggtcaatccccccaagcaggttgagcatggtggattttcccgcgccgctggcgcccagtatgactacaaattctccctcctcaatgtcaaaggaaacttttttcagtgcgtaattcttttgctgtcctgccttataatatctgctcacatgcttcagctctactattttcatttttcctcttttccgttactcaaaacgccagtacacaatactttaaataccttgacaaattcttttttagactcctctgtccctttgtgctctgataatacgtggcgcacgcaggcgataaatgtattcataatgatatccacataagcggaatcatcgtcatccatccccagatgccatgccaaatgctgtttaaatttatgtatggcatcatccctgatcttcacaaagcgtgttgtccttaagtcaaataatatcacaagcctctcgtccatgagacactgcatctcatgataatccatcagattatccaaatcatccagaaatccctgcatctctgacattgtgaacagctcatcctgcaatttcatatggtcgtctatcattttcttcaccttttcgacaggctcccgcataagttcttccagaatggcttctttgttttcataatagtgatatatatttcccagggttgtgttggctttttttgcaattgtgcgcatggaagccccctcatacccgtgaatgagaaattccttctgtgctgcctctaatatggtcttcctgatttcgtcttttttcgtctgcacgccctgtcacctcctgcaaatatgatatctgctttttcatgcggttacaagaacctgatgcctataaaaatcaaaacttaacggctgttcatttttcttatggaaaccagatatattttaattgataaatatacgaaccacatcccatttttgtccaaaaaataagacggcagctttgaattatcctcaaaactaccgccttattagaatgttagtgataactattcagtaggtctgcgcatttactgcgctgaccgtaaataaacgttctgcatgcttttactgtgccgggatcttgatatgcacagtgctgtcatttcacaacaggatgttcctgggcatattttcttccataggaatgcagttcgtccatgactatgctattattccactcccggaaacagattccgtttggtatggacggataaaatcttccgccaggacaataggtatcaatggctcttctgacttctgcccggatttcttcctccgtgatattctcaatatccactttcgggccgtcaatacctccaaccatggcaatctttccctctgtcactctctggatctccacgatatcgttctgtgcgattgccccctgccagatatccactccgatttccaccatatccgttacgatcggctgacagatacagtctgcatgatgcatatatatcataccacaggcatgaatggtatccgcaatctctttttgcagaggcttgataatttcccgccatacccttggcggaagaaaaacgttttgtttggaaccccagtcatcgtgataaaaaatgatatccgggtgtatctgctccgcaaccattttgatatatttcattttatagtctgcgatcacccggagcagccctgccatttcatccggatattccagataattcaccagcgcctcttccatccccatcagatgatgggagcgctcaaacagaccgccggcacacataaatcccacaaatttttcttttctgtctacttttgccgcttcctctttcacaagagtccagtccaaatgttccaaatccggcaccgtgagctgctcttcccacttttcaatatctttgataactgcattttccttatttacccttggatgggggccgggcgcacctggtttaaagatatagactgttccccaggaatccttatgctccaacccatcctgaggacacatgtcccccataagcacaggatccggaacaagcacgatggcgtccatcagatcaccataaaaatccggctgctccctgttataaattgccattgcattttcccgcagattcatattattatttcctccttcatctctttctttacggtaactgttccgcgcttcggctaaatcgttacgtgttacggacattttcatagttctattgtataacaatccatgttttcagaaaatgttcagactgtatctatttttccagtccttatatgcactctgcccattctttttcttgacaaatatcctcataaataataagattttgacaaaggagtgcattcatatgaaaataaatctggatatcatcgcagaagaattatctgctctttcccccaggcgggcaggcagacaaaaatcagatacggtcaaacacaacttgcagggtgccggcctgtatgaaccgcaaacaaccctgtcaccggagatctgttatgccgtcagtactgacaccataacagaaacctttttttgtccttccggcatcacactggctgtgattggaaacgctgatgaagatatgctgaatgcattcgatgcagatatccttgtgctgaacgcagagaatgcacactgcacattcagcgatatgtttaatgcgctcaattcggttttcttaaaataccaggcgatccatgcacggctcacttctgcggtcatgaaaaacgccccgctccaggaaatactaaaaatcggggaagaacttttcggcaatcctctcattcttttcgataagaattactgtattttaggggaagctgattcacgcctcaagaagctggaactggtctgtgacaaatggtctgattcaaaaatgctctccattgatatggtcaatgccataaagacttcaccggaataccgccgatcttccgcctcctctgatatctgttttgtttcagacgaatattttgcctataatacactttttgtccctgtggagggaaatacttctcctttgacagcagccgtcatggagacagaccgccctcttaccctggtgcatcggcagcttgctctatattttgcgggaatcctgcgtcttgctctggggagaaatcatttaagctcgggacattctctgagatttgaagattttttaaaggaacttctgtacgacacgcagatcgaacaggctgtgatagaccgctatcttttggctatgaattggaaaaacggggataactatcttctggtaacttttcagacaaaccgttttgacaaaatcaattccatatacaacaatatctgcgtcaatattgaaaaacaggttgcggagagctttgccttttattttgaggacaacctgctcactgtcatcaatctggaccatgcacgtctatcaaaggcggatgcggtccataagctctctattttcctccgggaagggctgtttcacgccggcatcagttacgtcttctttgatttcagcactttttccagctattataagcagacattgggggctttggagatgggtgaaaaatatagcccccatgagtggtgctatgattttgaggactatgtgctgcattattttatgcattacggcacaagccggatcgacggaagacatctgtgccatcccggtgtagtccagctttatatccatgacttaaagaataaaacaaaccttctggagactttaaggacttatctggagctgggaggcaatgcggttctcactgcacagaaactttatatccacagaaataccctgtatcagagactgaaaaaaataaatggcatcatccataccaatctggatgacgccaatacaaggctgttcattatgatgtcctatacttttgtggatttgcttggattaagtccagtggaatcctgacgcattttctcccaatcactcttcaacatgcgatattccatacgtgttttcattttgccgtcatgccactcatagtccacatgttctgcctctcttatcattccgcatttctgcataacacgctcggagcctctgttttctctgaggcatccggtggtgatgcggtatacaccatcctgggaaaaagcaaattccattaccttttcaagcgcctcagtcacataaccgcagctccagtatttcggatatgtaaaatatcccagatgcaccagttttcctgccggagttgtatccgtgaccgtataaccaatgcttccaatctgttctcctgtatcctttttctgtatatgaagaaaatatctttgcctgtccttctcccgcatatccagaaggatatttctaaaatcctcttccgattcctctctggaatggtgttgaatatcccgaagataatacatcacctgatcatcagccataagtctgctgtactcttctgcatcgttctccgtgtaatcccgtaagatgagacgttctgtttccaggtatatcatatgggtatctcctgtattttgtgcttgtagtaatttttgtgcttatactccagtgcgaaactggagacctggctgaaaatgcttttccctagcttcagcagatttcaatccactccggcacaaagccggagaccgaacccctggaacgctaacaatgtgcgtcttgtatttcaattcaccccggcacaaagccggagacatataatttatcaaagataatgacaagagcatggatttcaattcactccggcacaaagccggagactttcttttggcatttcctttatttcatctgcaaaatttcaattcactccggcacaaagccagagactgacaaagggatggaagtgatccgcaaacgagcaatttcaattcactccggcacaaagccagagacccctgggtgggaacgggaccattacacacatgtggatttcaattcactccggcacaaagccagagacggcaattttatccaaacacccccattattaatcaccattattaatcaccattttttatacaaaaaacacactaaaaatttgattatccgctaaaacactgtatctatcggcattatcaaggagctaaacacatcaaaatactactaatttactacgattgaatgagccttgatacgtcctatttcccagatatgcaaagatacggtacagcacatcagtattgaaacaagaaaaattgaatacttcatagactacggaacgcacaatatcagcgttccttttctatttccagccgttcctagtggacggctattttactaccaaaatgaaaggagcatttagaattatgaaaaagatattaaaacgattgtgtacaggctttcttgcctttgcaactgtcgttaccgctttaccgagttcaacggttcatgcgtctaatacacagtattggacggaaagtaaagagcgtgtcggtatcgtagaacaagtaatgaatgacggttctatcagttctacctttaatgagggacatttaactgttgagggcgaggacgcatattgtatcgacatcaacacagcctttaaaaacggctataagaccaaagctaacgcaagtacccgtatgagtgccgaccagatagctgacgtcgccttatctattgagtatgtgaaacagtacacagacagccacagcggaataagcagtaaacacgcctaccttttaagacagttagttgtctggcagagattaagtgttcatttaggctggaattgtgataatgtgcgagcttcttatgatgaaatgccaaaagccgtacaagatgaagtattcgcaggagcaaaagcctttgtgaaagaaaacaaaggacgttatgactgtggcggatatatctattctggcgagggtcaagagttagggcaattctgggcgaagttagctgtcggaaatgccaaacttcaaaagacttccaccaatgccaatattacagacggcaacgggatttattcaatcgctggtgcaacgtatggtgtgtattctgataaagactgcacgaaaccgcttgccacccttacgactgatactagcggaaatacagaagctgttgaagtaagagccactacagtatatatcaaggaactttctgcaccagcaggatttaaaattgataaaacagtttactctttatctgtggaagctggaaaaacagcgactttaaaagtatctgatactccaaaagtaacagataccttgattgagctgttcaagattgacatggaaacacagaaatccaatccgcagggaaacgcttctttagagggagcagagtttacatggaacttctacgctggatattacaacaagaacaatcttccagcacagcctacaagaacatgggtaacaaagactatcgctgaaaaagacagcgacggtgctatccattacattactcgtttagctgacaaatataaagtatctggggacagcttctatacgcaggacggtaaaaacgtacttccattaggaacactaactgttgaggaaacaaaaagtccgtcgggttacttgttagcgggtgcatatatgcaggctgacggtagcgaagaacagataaaaggaatgtatctgacacagattacagaggacggcgaccttgccgtattgtctggaagtaatcagtaccatgtatcagataaagtcattcgtggcggtgtgaaaatccaaaaacgagatttagaaacgggtgacacgaaagctcaaggcggtgcgactttgaaagataccacttttgaaatcatttccttaaatgataatactgtcttggttgagggcaagctatacaagaaaaatgaagtagtaaagacaatctataccgacattgagggtatcgcttctacttctgctggtttgttaccttacggaaaatttaggctgtctgaacaaaaaccgccagagggatatttgacagagggtgcaaaagagattgactttgaaatcacagagaatggaaaaatcgtagatttgaccgacgaggctcactctatctataaccagattaaacgtggcgatattgagggcgtaaagattggagcaggttcgcacaaacgtcttgcagatgttccgttcaggatcacaagcaagatgacgggcgaaagtcatattgtcgtaactgatgataacggacagttctctactgcgtcaaattgggcttcccacaagcacaataccaatgcaggaaaaacaagtgaggacggtgtatggtttggtacttctgaaccagacgacagcaaaggtgcattgctttatgatacctacatcattgaagaattacgttgtgaaagcaacaaaggctttaaacttattccaccgtttgagattgttatttccagaaataaagttgtcgttgatttaggtacgctgactgatgaatacgaaaaagaaatcactattcataccacagcgaccagcaaagacggcgaaaaaaatatccttgcagggaaaaaggttactatcattgataccgtgaaattagacggtcttatcaaaggcacaaagtatcagttaaaaggctggcagatgttgaaagaagaaaatgcagaacttcttatcaatggtaaacgagtagaaaacgattatacttttgtcgctgatgatgaagctatgaaagtggaaattgcctatacattcaatgcgtctgctcttggtagtaaaaatctggtaacattcgaggaattatacgatttaagcaatccagaagaacccgtgaaagttgcggaacacaaggacattgaggacgatggacagacggtgcttatcacagagcgtatcatcaaaatccatacgacagctacggataaagacggcaagaaagagattgaagctggaaaagatgtaactatcgtcgatacagttaaattagagggcttagaagtaggtacgaagtatcagcttgtgggctggcagatgttaaaagatgaaaatgccgagttaatcatcaatgataaacgtgttgaaaatgattatatctttacgtctgacagtgaaactatggaagtaaagattgcatttacttttgacgcttctgctcttggcggtaaacagcttgtaacttttgagaaattatacgatttaagcaatccagatgaaccgataaaagttacggagcataaggacattgaggacgacgggcagacggttactatcaaagaagcaccagaaacacctacgccagaagaaccagagaagccaactccaccagatacacctacgaaaacagacagtccaaaaacgggcgacaatacaaacctttacggactgattgcaatgctttgtatctctggtgctggtttaactggtacatatttctttaaacgtcgtaagatgaagaaatcataaggcggtagctgtatgaggaaagaaaaatcacgctctccgccgtaacatataaaggcagactatatcttattctggcttgtctgccgattacctgcaagaacacggatagtcaagagggcgttagcatttatttaccctttactatctgggggcttgctggtactttcctaaatgccagaacacacacatcaatcaaacttaaagaaagaaacgaggtaaaataatatggaattaaaatatatcgtgccgaatgtggcacagacttttggaaacttggaatttgcaggggaaaacaaagtagaccagcaacgtatcaatgggcgttacactcccgtatcaagaagttacaacttgtattcggatattcagagagccgacgacattatcgttgtattacctgcaaaagctggcgagaagcattttaagccagagcagaaagtaaaactgattaacccacgcattaccgcagagggttacaacgtcaaaggacgtggatttacaaactacattttaatggctgatgatatgttaccagcagaaagcaaataagggggtatttgattatgagattagcaaatggaattgtattagataacgaaaaaacttttggagtattgaaattctctgcacttcgacatgaggtgcgtgtagaaaatgaggacggaacgacaagtgatgaaattaagcgtcgtacttatgatttgaaatgtagtgtgcaggaacgcatgatacaagtgtcaatccccgctgatgttcccgtaaaggactttccttataatgcggaagtggagttaatcaatcccgtagctgatacagtggcaaatgccaactttagagggactacggttgattggtacatcaaagctgatgatattgtattgaagaacaaagggggtaaagctggaaatccgcagaacaacgctccgcagggacagcagaaaaggtaagctgacaaactagtttttcattgtagcagatataaacaactgttataatatggatgtggaaacagttaattcagacttataaaggagaaacgaatatgctggataaaataccaaatgcagaagaaatgactgctttagtcggtaaatcattatatgatatatggaataaactgtgtatcttaattgatgaaaagtatgaaatggaatgcttgtggaacaaaggtggtaaagcgtggacttatgagtataaatatcgtcgaggtggaaaaacgctttgtgcgttgtacgcaagagaaaattgtgtaggatttatgattatcttagggaaagatgaacgattaaaattcgataaagatagaaatagttattcaaaagaagtgcaaaaaatttatgatgagacgaaaacttatcatgacggaaaatggctgatgtttgagccaacagatacagctttgtttgatgattttgttaaacttttgaggataaaaagaaaaccaaatagaaagtagtttatcacaccattagcaaatggatagtttcttataatagcggatatatgaaaatgctgtcatgtggacataaagaaaattggaagttgtggaggtagcaaaaatgaaattaaaaaaccctatgttggtagtaactgatatagataaatcagttgagttttataaaaaggtttttggacttcatgtcattatggattttggagcaaataaaactttaacaggtggcttagccttacagacaagtgaaacatacaaagagtttatcggtacaagtgatatttcttttggtggtaacaattttgaagtctattttgaagaagatgattttgataaatttgctgataggctgaaagaatatgatattgaatatgtccaccctattatagaacattcatggggacagcgtgtagtccgcttttatgacccagataaacatattatcgaagttggagaaaacatgaaaatagtatgtaagcgtttcttaaatagcggaatgacaccagaacaagttgcaaaacgcatggacgtgcctatgaaatttataaatgcctgtatgagataaattcttgtttgtagaagtcaataaatacaaagataaattagaatttgtcgaaaggagtagaaaactatgaaaatgccagaaaaaattgatataagtatgtttgctccatgcggaatgaattgtaaagtttgttataagcactgttaccacaaaaaaccttgtgctgggtgtttgaatagtgataaagggaaacctgaacattgtcgtaaatgcaaaataaaggactgtgtcaaagccaaagcgttatcctattgttttgaatgtgccaaatatccatgtaagttgattaaaaaccttgaaaaaagctataacaaacggtatcaagcaagtcttatagaaaatagtcgttttgttcaaggacaggatttggagcatttcatggaacagcagaaaataaaatatacttgttctgaatgcggtggaattatttctattcacgatagagaatgtagcgagtgtcaagaaaaaatgaaatagcaaaatcttcagtttgtaaaagacaataaatacaaagataaatttgaagttaggagactaatactatgaaaggatttgaacgcaaaaaccaattattctctctttgtggattgaattgtgggttgtgtcctatgcttttaggaaatcattgtggcggttgcggaaatggaaatcaatcatgtaaaattgcaagatgtagtcttgaacatggaaagattgaatattgctatgagtgtaagcaatatccatgtgaaatataccaacacattgatgactatgatatttttattacgagcagacgacaaaaagcagatttagaaagagcaaaaaacataggcattgagcaatataatcttgaacagcaggaaaaaatacaaatcctttcttacttactttctaactataatgacgggcgtaggaaaactttcttttgtgtgacagtcaatttactagaactttcagaattgcaagaagcaatgaaacaaatacaatccaatgacgaattgtccttactaccatttaaggcacaatgcttgtatgtggtggaggtgtttcagaagattgctgaaagaagaaatataaaactgaaacttatcaagaaaaagtgattttcaaatttcagtttgacaattttatatccatacacacaaagcagttagtcttaggattaactgtttttttcgtacccagaaaggagtgattgatttatgagaatgatttttaataaaggacaccgtatcagagccagcgacaagcaccttgtctaccatttttccatagggacgcttctttttgtattcgtggtagttcttctgctattgaatatgaaacagctcatgcgtaccgattggaagcatatcagcttgttagagaacggcttgacgctttccccttacaacttcataaccatactgatagcgactggtgtttgtgcattggtcgctttttggtattaccgcttctgctatgacagtttcaagaagctactgcaccgtcaaaagctggcaagaatgatattggaaaacaagtggtatgaagccgataccgtacaagacagcggtttttttactgacctgcaaagcagatcaagggaaaaaatcgtctggtttccaaagatttactatcaaatggaaaaaggattgcttcatatccgctgtgaaattacgctggggaaatatcaagaccagctcttacgattagaggataaattggaaagtggcttgtactgtgaactgaccgacaagaccttgcatgacggctacattgaatacacgcttttgtatgatatgatagcaaaccgtatttctattgatgaagtgaaagcagaaaacggctgtcttaggctgatgaaaaatcttgtcttggaatataacgcactccctcacacccttatcgctggtgggattggcggtggtaaaacatactttctgctaaatctcattgaagccttgttacagaccaacgccgagctttacatcttagacccgaagaacgctgaccttgcggacttgagaacagttatgccaaatgtctatcatacgaaagaagaaatgattgattgtgtcaatgccttttatgacggtatggtggcacgaagcgaagaaatgaaacagcacccgaagtataagacgggcgaaaactacgcttatctgggactaccgccctgctttctaatctttgatgaatatgtggcgttttttgaaatgctagcaacaaaggaaagcatgagcttacttagccagctaaagaaaatcgttatgttaggacgacaagcaggctattttctgattgtcgcctgccagcgtccagacgcaaaatatttcagcgacgggataagggataacttcaacttccgtgtagggcttgggcgtatcagcgaattaggttacggtatgctgttcggttcagatgtgaaaaagcagtttttccagaagcgtatcaaagggcgtggctactgtgatgtagggacaagtgttatcagcgagttttacactccccttgtacccaaagggtatgacttcttacagacaatcggctctctagcatacgctaggcaggacgggacggcgacgtgcgaagcgaaaggcgacggcacggactagccgttgctggtgtggcggtagccacgccagcagacatcagcccctcattatctaacagaggggcacaaatacattggaaactggcataaaaagtcttggaagtccgcatggaataaggctttttacaagtttcagccgtttgtgatatgggcttgaaaatatcacaatttcaaagattgggggtatcacaactgaaagatgatgattttataacagccttgaaagcaaaacgtagcgattacggcgtatcgcagacaaggcttgcactcatggctggtatcagccgtgaacacttaaaccgtatcgaagctggaacggtagcacttactaaggatatgaaaacgaagctgttggaagctgttgaaaaatttaatcccgacgaaccgctgttcctgctgttcgattatgtgcgtatccgttttcccacaatggacataaagcacgttatcaaggatattctgaaactgagtatcgactatatgctccatgaagattacggacactacaaatacaccgagcattactatatcggggacgtattcgtattcacttcacaagatgaagaaaaaggcgttctgctggaactcaaaggcaaaggctgtcgtcaatttgaaagctatctgctggcacaagagcgaagctggtatgacttcttcatggacgcactcattgagggcggtgtaatgaagcgtcttgaccttgctatcaatgacagaacgggaatattggatattccagaactgaccttgaaatgtacaaatgaagaatgtgtttctgtgttccgttcctttaagtcttacgcttctggcgagcttgtaaagcacaaggaagctgacaaggcaggtatgggacatacgctgtatatcggttctttgaaatcggaagtttacttctgtgtgtatgaaaagaattatgaacagtacgcaaagctgggaataccgattgaggaagtcccgataaagaaccgatttgaaatccgcttgaaagatgaacgtgcttattatgccgtccgagatttgctgacttattacgacgcagaaaggacggcattttctattatcaactgttatatccgttttgcagataaagagccagataaacgaaaaagcgaatggaaaaccaatgaccgctgggcgtggttcattggcgagggacgaccaccattaagattgacaacaaaaccagagccttacacgctggagcgtacattacggtgggtggaaaggcaggttgacccaacattaaaaatgctggaagaaatcacaaagaaaacgggtgtcgattatctgaaagagatacgcaagcatacaaagctgacagagaaacacgaacagataatcgcacagcagactgcttccccagaggaagtgatagtaaagtaaaggagcatggaaacatggaacgaatactatttggttttcttttccttacgcttggcatggggcttggcgttatactgatgtgtttaatgcaggcaggaaaagaagcagacaaagaaatggaatgattaaaagaaagtgaggacaaataaatgaatttcggacaaaatttatatacttggtttttgagcaatgcacagtcattagtgcttatggcaatcgtggtaattggtatctacttaggatttaagcgtgagttttcaaagctcattggcttcttggtagttgcccttatcgctgttggtctggtatttaatgctggcggtgtcaaagacgtgttgttagagctgttcaataagattatcggtgcataatgatttttattgttatagtaatttagcaatggtacaatgtgggtataaattaaaagttataggagtgatattttgaaaaaagctatactgtatattcatggtaaaggtggaagctatttagaagctgaacaatataaagaaatctgtatcgggtatgatgttataggaattgattacaacgaatacctgccgtggatagtagaaaatcaaattaaatctgtgtatgaaaaccttagaaatgattatgagcatatttccattatagcaaatagtattggagcgtatttttcaatgtacgcattacaaaactatgatattgagaaagcattttttatatctcctattctggatatggaaaagctcattctcgatatgatggtatgggcgaatgtaacagaaaaagaacttttggaaaagaaagaaatctctactgattttggagaaactttatcatggaattatttagaatttactaggaaaaatcctattacatggaatgttccgactgaaattctctatgctggaaatgataaccttacttctcgcaatacagtaaattcttttgttgaaaatcataatgctaatcttaccataatggaaaatggagaacattggtttcacacagaacaacaagttgattttctgcacaaatggataaaaaatgtactataacaatttcatacccacataaaaagcagtcattctgaaaagatcgactgcttttttcatacctaaaattagattggagtgattgcttgaatgatatttttaaggatatgcaggcaaggattggctgtcaatatatatcaggtttaccctttaaacgaagtgctgtctggtatgaattgaagcacttaaaccttgccgactatcctatgaaacaactagaagatttttcacgctatgtctttggtgtcccgtacaccgtcatagcggaagttttaaaaagaaaggacgtgataacctatgcaggaattacgagtgttgctggaaacgaaacaaacgataaatgatgaaatccgttctgcttggtttgccctgccgattgatgaagaagaattgcgggaacgattaggtgtggacgcagaaagcgaggactatcgtattcttgaaaaagaactgccctttgctgatgatgtgggcgaagatacgaccattgagcgattgaatgatatgtaccgtacctttgaaagtctgccagcggatttaaaggaagattacgacgagctgatgtgctacttctctagtctggacgaattgcaccagcatagaaacgacatcattcattattcatggtgtaagaacatgaccgacgttgctcatcgtgtacttgataatgaccctgccttttcttccgttgaagaacgcattacccgttactttgattttgaagcctacggacagtatcttgacgataacggacgctttctggaaacggaacacggtatctatgaaataccgtaaaagcgaggtggcattttatggttgaagatatggcggtgtatatcgctaatcttggaaaatacaatgaggggtatctggtgggcgattggttccgttttcccttgaatgaggaagaaatcgcagagcgtatcggtttaaatgccgagtatgaagaatacgccgtccatgataccgacaactttcctatggaagtatcagaatacatttccattgaggaattaaacaatatctatgatatgctagaggaacttcccgactatatcgtagacagtctggacgagtttatttctcattatggaagtctggaagaattagcagaacacaccgacgagatttatcattatcccgattgtgaaactatgacggacgtagcttattatttcattgatgaattgcagatgttgggggaaatcccaccgcagttgcaaaactatatcgactatgaagcctacggacgtgatttatcctttgagggaacatttattgaaacaagtagcggtatgtgtgaaataccatattagagctggaagatcagcaacgagcattgttgcttctgacagctcatttacatttaaggacagtctgaaacacggctgtccttttccaattcaaagaaaggagtttttctgaacgtatgaagaaaataaaaagctatacgggtatctggaacgtggaaaaagtcttatatgcaatcaatgactttagcctgccctttcctgttacttttacccagattacatggtttgtcatgacagaatttatcatcattctgcttggcgacctgccaccgctttccatgattgagggagcatttttaaaatactttggtattcccgttgctctcacatggtttatgagccagaaaacctttgacggcaagaagccttacagcttcctaaagtccgtgatgacttatgccgtccgacctaaaatcacttatgcaggaaaagccgtgaaactgcatgagcagaaattcaatgaaacaatcacggcagttaggagtgtgaattatgttcccaattaaatatatcgacaataaccttgtctggaacaaggacaatgaagttttcgcttactatgagctgataccctacaattacagcttcttgtcggcagaacaaaaatatatcgtgcatgacagcttccgacagttaatcgcacagtcccgcgagggtaaaatccatgcgttacagattgcgacggaaagctccgtaaggagtattcaagaacagtccaaaaagctggtgtctggcaggcttcgtgatgtggcgatacaaaagattgatgaacagacagaagcccttgtatctatgattggcgataatcaagtggactatcgtttcttcttgggctttaagctcatggttacggagcaggaagtcaatttaaagaacatgaagaaatcgctgtttatgacggtcaaagagtttctaaatgaagtcaatcacacgctgatgaatgactttgtttccatgacaaatgatgaaatcaaccgctatatgaaaatggaaaagctgttagagaataaaatctctaggcgtttcaaggttcgacgcttggataaaaacgacttcgggtatctcatggaacacctttacggcagggacggcgtggcttatgaagattatgagtattccttaccagagaagaaattgaaaaaggaaacccttatcaagtattacgaccttatccgacctatccgttgtctgattgaagaaagccagcgatacttgcgtctggagcatgaggacagcgaaagttatgtatcgtactttaccgtcaatgcgattgtcggggagctggattttccgtcaagtgaaatcttctatttccagcaacagcagtttatctttcccgtcgatacgtccatgaatgtagaaattgtagaaaaccgcaaggcactttccgttgtccgtaacaagaaaaaggagctgaaagatttagataatcacgcttttcagtctggaagtgaaacaagctccaatgtggtggacgcattagacagcgtggatgagctggaaacagatttagaccaaagtaaagaaagtatgtacaagctctcttatgttatccgtgtatctgctcccgacttggacgagctgaaacgccgttgtgatgaagtcaaggacttctacgacgatttgaacgtaaaactagtgcgtcctgctggcgatatgcttggacttcactctgaatttctccctgccagcaagcgatacatcaatgactatgtgcagtatgtaaagtccgacttcttggctggtcttggatttggagcgacacagcagttaggcgaaaacacgggtatctatatcggttattccgttgatacgggaagaaacgtgtagttacagccgtcgattgcaagtcaaggaattaaagggactgttaccaatgctttagcttctgcctttgtaggaagtcttggcggtggcaagtcattctgtaacaacttacttgtgtactattccgttctctttggcggtcaagtggtcatcttagaccctaaatccgagagaggaaattggaaagaaacgctcccagagattgcacatgaaatcaatatcgtaaaccttaccagcgaaaaggaaaatgcaggacttcttgacccatttgtgattatgcgtgatgtgaaagacgctgaaagtctggcaatcgacatactcacattccttacgggtatttcgtcaagggacggcgagaaatttcccgtacttcgcaaggcggttcgctccgtcgtgcaaagctcatcaaggggattgctccatgtgatagacgagctacgcagggaagatacaccaatatcaagaaacattgccgaccatattgacagttttaccgattacgattttgcacatctgctgttttcagacggtacggtggaaaatgctatcagtctggaaaaccagctcaacatcattcaagtagcggatttggtattacccgacaaggacacgacctttgaggaatacacaacgattgaattgttatctgtatcaatgctgattgttatttctacctttgccttagactttatccactcggacagaagcatttttaagattgtggatttagatgaagcatgggcgttcctcaatgtagcacaaggcgaaacgctctctaataagctggtgcgtgctggacgtgctatgaacgcaggcgtttacttcgttactcagagtgcgacggacgtatcaaaggaaagtctgaaaaacaatatcggtctgaaattcgctttccgtagtaccgctattgaggaaatcaagcagaccctagaatttttcggtatcgacaaggatgacgaaaacaaccagaaacgcttgcgtgatttagagaacggacaatgtttattgcaggacttatacggacgtgtcggtgtagtacagatacacccagtctttgaagaactactgctcgcctttgataccagaccgcccgtacaaagaaatgaggtggagtgatgaaagaaaggataaaaggtgcattcacaagaaaaaagatatttcactttctcaaaatggctctgttcgtcatgggacttacccttatcctgctttcactcttggggacggtagctcatgcgacgggacttgtggacgacacaataaatgcagaaaacctttactcaaaatatccgctgtcaaactatcagctagacttctatgtagataatagctggtcgtggcttccgtggaattggctggacggtatcggaaaatcggtgcaatacgggctttactgtattaccaactttgtctggactattagcttgtatctttccaatgcgacgggatatgtggtgcaggaagcctataaattagacttcatcaacgatatggcagacagtatcggcaagagcatacagacccttgcaggcgttaccgagaacggcttttctacctctgggttttatgtaggcttcttattgatgattattttagttgtcggtatctatgtagcctatacaggacttatcaaaagagaaaccagcaaggcattacacgctgttatcaactttgttgtggtgttcatcttgtcagcttcctttattgcgtatgctcccgattacataaagaaagtcaatgacttttcatcagatattagtaccgcttctttggacttgggaacaaaaatcatgctcccagacagcgacagtcaaggaaaggacagtgtggatttgataagggacagcctattttctattcaagtcaaacagccgtggctactcttgcagtttggcaacagcgacgtggaagaaatcggggctgaccgtgtggaagctctagtatcagtcaatccagacgacgaggacggcgaaacaagagaagatgcagtaaagacagagattgaggataacgacaataacaatctcacgataccgcaggtcgtgaaccgtttaggcatggtattcttcctcttgttcttcaacttagggataaccatatttgtattcctgcttacaggcatgatgatattttcgcagatactctttatcatctttgcaatgtttttaccaatcagctttttattatccatgataccgagctatgaaagcatggcaaagcaggcaatcgtaagagtattcaataccattatgacaagagctggaattacgctcattgtaacggtggcatttagtatttctagtatgttttacaacatttcaacggactatccgttttttatggtggcgttcttgcagatagtatgtttcgctggtatctacatgaagttgggcgatttgatgagtatgttctcattgaacgctggcgacagtcaacaaatgggacgcaggatattccgcagaccgtatttatatatgcgacatagagccagaagatttgagcgtcgtgtcgctggtgcggttacggctggcggtatcgctggtgcggtagctggtaatgctgtatcgggtagtaaacagaaacagcagacacaaactcgtagcaatacttcttctagcatagggcgcaaggctggaaatgccgtaggtgctgtcttagatacgaaaaataaggttaaggataaggcaaacgctgtccgtgaaaatatcaaggacgtaccgacccagaccgcttatgccgttcattccgcaaaggaaaaggcgaagtcaagtgtatcggattttaagcgtggcgtggtgcaggaacaaaacgagcgtcaagctgggcgttatgagaaacagcaacagcatagacagaatatcgctgataaaagaatggaattacagaaagctcaagaagcaaagtccggaagaaaaacggacggatcagcgacagcaggagctacccgtccacatgaaagaccagcgactgcttctgcttcagaagtgaaaaaacaaagtaccagcaaaccgcaggaagtcaaacgccctgccacttcctctaaagctgatgatgtgaaaatggttaaggagcgtccgcttgcttcttctgggaaatcggttgaaccgacggtaaaagtaaaccgccagaatttacatacggagcgtatcacaaagacacagcagacaacggttcaaaagaaccagcagaccacagagaaaaaccgtaaactgattacgaagaaaggacagaagaaaaaatgagattgaaacacatagctatcattggctgtctgtttcctattctattttctatcgtcttattctttggggtgctgattagtgccgaggacgacgacggcggtgggaattattcatcttccattggtggtatgaacctatccgcagaggtcttgaaacatcagccaatggtggaaaaatacgcaaaggaaaatggtatttccgagtatgtaaatgtgcttcttgcaattattcaagtagaaagtggcggtacagccgaggacgttatgcagagttcggaaagtctgggactaccgcctaattccttagatacagaaagctcaatcaagcaggggtgtaaatattttgcgtctctgctttcttcgtgtgaagcacaagggataaaagacttgaatgtagcgatacagtcttataactacggcgatggctatgtgggatatgtggcaggaaacggaaagaaacatacctttacccttgccgagaatttcgcccgtgaaaaatcgggcggtaaaaaagttacttacaccaacccgatagccgttgcgaaaaacggtggctggcgttatggctatggaaatatgttctatgtggagcttgtcaatcaatatctgaccgttacccactttgataatgcgacggtacaaaagattatgaacgaagctctaaagtatcaaggctggaagtatgtttacggcggtagcaatcctaatacatcttttgattgtagcggactgacgcaatggtgctttggaaaggctggtatctctattccgagaaccgcacaagcacagtatgacgctacccagcatttaccgctgtcgcaggcacaagctggcgatttggtattttttcattccacttacaatgcaggaagttatgtaacacacgttggtatctatgtaggaaacaatcagatgtatcatgcaggcgaccctatcggatatgcggacttaaccagcagttattggcaggcacacttaatcggtgcaggcagaataaaacaatagaaagtgaggacttacaatttatgtttaagaagaaagagaaacagataaaacccgtgaaagaaaaaaaggtgcgtaccatgaaagtaggcacacataagaaatcagttatagctctttgggtcgtgcttatcgcaagcgtgagctttggggtgtataagaattttaccgctattgatatgcacacggtacatgaaaaggaaaccatacagctacgacttgatgataccaacggcatagaaaactttgtaaagaattttgcgaagtcatattatacttggaacaacagcaaggaagcaatcgaagcccgtactgcttctatcaatgggtatctgacaaaggagttgcaggcactaaatgtcgataccataagaacggatataccgaccagctctagtgttcttgatgtgctaatctgggacgtggcacagtctggaacggacgaatttatcgctacctacgaagtagatcagcagataaaagagggcgaccagacaaacaatgtaacagcaacctatacggtaaaaatccatgtagataaggacggaaatatggttattattcagaacccgacccttgcaccagatgtaaaaacatcagtctatgaacctaaagcactagaagctgacaacagcgtggacgctgacactataaacgacgctaccgcatttctggaaacattctttaaactgtaccctacggcaacggataaagagcttgcttattatgtatctggcaatgtccttgaaccaatcggcagggactacctctactctgaattggtaaacccattctttacagccgacggggacaatgtaaaagtcaaggttgcggtaaagttcattgacaatcagacaaaggcgacgcaggtatcacagtttgaattgacgctccataaggatagcaactggaagattgtaaggtaacatgaaaacgggtttgtatcataactgtggtgtgcaagcccttattatattgaagtataaattaacaataattataattaggtacatgaatggagggataaaatgttcaaaattggtgagttttcaaaattgacacaagtttctactcgaatgttgcgttattatgatgaaatgggtttgttaaagcctgctaaaatcgattcattgactggatatcgtatgtattcagcagaacaaatctcaactttaaatagaatcatatatttgcgtgatagtggcttcaatgttgctgaaattgcattagccctcaattacagtaatattgccattatagaacagcttgataaaaagtctattgaaattatggataatatacagaaagaacaagaaaaattaaagaaaattgagattgctaaaaaggaattgttacatggcaaaagtgaattgtattttaacataaccataaaagagataccgagttattgtgttttatctttaagaaaagaaataccagattattattacgagggcgagctctggaaagaactttctgcttttgctaaagaaaataaaatagatattgctgatgaaacgttctcaatatatcacaatgtggaatataaagaaaaagatgttgatgtagaattatgtgcatttgtaaataaaataggaaaagatactggcgattttaagtttcgttttaccgaaccagtttctatgatggcttgtactatggtatatggagatttttctaatatttcttatgcttatcgttcatttgctaaatggcttcaagaaaacagtcaatataaaatgaaaggttcaagccgtcaaatagttcatcgtggaccgtggaacgagaaaaatccagagaactatctaacagaaatccaaattcctttagaaaatctcttgtaaaaaatgataatctgccttgactttaacatggtgttaaggtttatcgtttatttagcaagaagaaaacggaggaaaatacaatgacaacttataaagtaaattcaataggtactatctacaacaatgaaaatagtgctttcattcaacttgaagcaccatatattccagcattaaaggaattagacggatttagtcatatcaatgttttatggtggtttagcgattttgacaatgaggatttcagaagcgtattggaaacagaccagccttataaaaaagctccagaaaaaatggggatttttgcaacaaggtcgccagtacgcccaaatccgattgcattatcagcagtagaaattatcaatattgattatataagtgggctgataaaaattgcttacattgatgctaatgacaaaacgcctatcttggatattaaaccatacacgccgagtttggatagagtggaaaatccgcaggttccagattggtgtagtcattggcctcatagcttagaagaatctgcttcttttgcatgggaaaacgaattcaatttttaaggagtaatgaaccatgagtttgcaggagtacatttttgaaaaaccagtaattgaaacagaacgccttattttaagaacaatgaataaaagtgatattgatgatttgaaagaatggattagtgatatttctttatatgagtattggggcaagcgtccatcaaaaagcgaaaaaaatccagaagtactctttaataagccagaaaaagctactaaaagttttcattggggaattgtccataaacaagatagcaaagtgattggtgaaatatggatatatcttattgaaaataatagaatggcaaaagtggctttcagactttctaagcaatatcaaggtaatggactaatgagtgaagcgttgaaaagcgtaattgaattttgttttttaaaaacagaattacaaaaattatggacagatgtgcatattttaaatcatgcttcttataaaacattagagaaagtaggttttcaaaaagaaggacatattcgtgaggggaaaatggtaaatacctattgcgactactacctatatgggattttgaaatatgattatgtcagtagctgatgttatggctaatattgaagcgacgattggcaaagcaatgaaccacagttccaaaggtctatgatacgaaaagcattaaaagatatgtgatgaatttattagatatggctcattaaaaagtaccaaagaaataaaagttaccatatagacaaaattggttttttatatcttttgatttcttataagataatggcattgtgcgacaagccgtacaaatatttttcgtgtatactgtaactataaaaaaaaaggaggtactgatatgtacgcatatgaaaatattgaaatgtcattaaattacattgaacaacacttgaatgagaaaattgaaacagagaaactagcaaagattgcctgtctatctacattttattaccagagactatttaaaaaattagtcaagaaatcagttcaagaatatattaaacttcgtcgtttagcaatggtaataacagaattaaataattcggaggaaagaatattagacatagctttaaaatatggattttcagaccatgctaatttcaccagggcatttaaagaagtttaccatattactcctgatgaatacagaaagagcgttcctatgttaaatacatttgacaagccagaactttcttctcattatgttttgattgatgaaaatgtcccactgattgtagggggtattgttctggaaattcaaaggaaaacattaaaagcaagcgaaacgtattttggttttaaaaaagcagtaaatgtcgatgaacagattccccctggaaaaagcacgggaattgatattccgggtcagctatggcgtgagtttcatgcaaagaaaatgcagaccgaaaatgttgtttttaacaacaatattgaactcggcgtgtctcattcggcaaatccagataaaggaacgttcctttattttgcgggaggtatggtttcatcaacagatgtatgtcctaaaaatatggtacaacatacattaccagcaggtgaatatgttgtatgccgaattgaggcagaatcttttgataaacttgttactactgctttaaatcaagcaaataagtatctgtttgaaacttggcttccaaatcataaactggttacaaagccgttcatggcagaaaaatactacaaggaaaatgcagattttagttatatggaaatttgggtaattcctgtggaaataggaaatgctgaaaaggaattatccaacacgaatgaaaatgaaataaaaagtctataaaggagggcatagaccgttgtgataaatataaaagatataaattatgcacctaatattagtgaaataagcagttatattgaaaaccctatatttgatgagttctatcagtatatgaacgataaatataaagcggtttgcaaaatcgaatacagtaaagatgtctgggacgactacgaaacagattatacaattttcaatgtaggcggtaatgatattcgtatttgtgatgatgaattggcagaagccttgaaaaagctgtccgaacgtaactgtgaaaatttactgatgtactatttcttggacatgaacaatagtaacttgaagataattggataaatcaaaagaagtagtttgtatttcatagaaatatgatttgcaaactacattttcattgaattatattcacaaatagttctgaataagttaaaataataattcatgtaaaaaccgcaatatatattaaaacttgaagaaaacaaagtattataatctaagctgaaaggagggtgctgtaatggtcaataaggttgaaaacattataactgttatcaattacatagaagacaatctcacagaaaaactaaacttatcttctattgcgatgggcgttgggtattcaaagtatcatttgcatagaatgtttgtcgaaactgtggggttgtctatacatgactatgtacaacgcagacaattaacagaatctgcaaaacttttagtgttttctgataaatctattcttgaaatctcacttattgctgggtatgaaagtcagcaagcatttacaaatatttttaagcagatgtataagaaaacgcctaatgaatatcgagtgaacgaagagttttatccgttacagcttagatttgatttgatacaaacaattaaacaaaaattatcacaaaaagaaataaaagaaaatattaggtttgccacaacaactgatatacctgcctgcctagaactagcttatttagtaatagacggctttccaaatttgaatgataatgaatatttatcagaattagaaagaggtattttagagcaaagagtattgattttaagtgataatgatattgccattgctttgatgtctattaactatcatacgggaagtattgatttctttggagtacaccctttatatcgtaaatgtggtattacaaaattgtttttagataaggttatgaatgaacttttaatagataaagacatttctgtaacaacattccgtgagggcgacaaagctgatacagggtatcgtaaggcttacaaagaattaggctttgcagaagcagaattattatttgaatttggttatcctacacaaaaattagtattattttcaaaaaatgggggaagcacaaatgaatagtaatcctcttgcaaaagattttagtactggttctttattaaaatttgctttcccgacaatatccatgatgttatttatggggctttacactattgtagataccatatttatatcacgctttgtcaatacagatgctttatcagcaatcaacattgtttgtcctattattaatttaatcgtaggcttaggaacaatgatagctacgggtggtagtgccatagttgcaagaaaaatgggggcaggagaacccaaacgagcaaaacaggattttacactccttattttatttgggtttattttgggagcagtattttccattctgggaattatctttattgatgaaattatatatgctcttggagctgataatgttttatttccatattgtaaagattatttaactattattttactatttacacctgcaagtatgttgcaggtactatttcaaaatttatttgtaacagcaggaaaaccaactttgggactggttctttctgtatgtgctggtgtaatgaatatcgtatttgattatctctttatggttatatttgacatggggattgctggtgcaggatttggaactggaattggttatttgataccagctattacggggttaattgtctttagtaaaaaatcggggacattgtcttttgtaaaacctcttatagattttaaagtacttggagaaagttgtataaatggttcatcagaaatggttagccagctttcaacagcaattactacattctttttcaatcgtacaatgatgaatttattgggtgtaaatggtgtggcttctattactataattatatatacacaatttttacttacaacattatttattggtttttcaatgggcattgcccctataattagctataattttggggcaaacaattattatagattaaagaaaatatataaaatctgtatttctttcatttttgtaggttcaatatttatttttgcgttgtcctttataaatggaaatagtttggtgcatttatttactgggacgaatgaagcggtatataaaattgcaataaacggttttatgatatttgcatttagttttctttttttgggtttcaatatattttcatcagcaatttttactgcattatctaatggtaagctatctgctttaatttcttttctaaggacattcggctttataatgataggcttgttgataatgccacagttcattgggataacaggtgtatggttggctgttcccattgcagaaatattaacactatgtgtttcagtatatttgaattttcgtcttttgcgttcgtggaataatcagaataatagttatgaaaaaagtacagaaaggttactatgataggacttaaaaaacgagatataaaaaaggcattgaaagctggtgcagaagctggcggtgtgtcattggctgatgttcgggcaaacattgaagcaacgattgatgaagctatgaacagcaccgacccagaggtgcaggcaaatttcaaaaagtattttggaaataaacgccctacaccagaagaatatatttatacaattacaaagaaagcagttaaagggctgaaagtatgaaaatagaacgtctgataggaataatcttttatttaataaatagagagtgtgtaacaacaaatgaattagcacaaaagtttgaagtatctcgcagaacgattttacgagatattgacacactaactcttgccggtattccgatttattctgaattaggtgtaaatggtggctatataataaataaagattttaaggttgatgaaaaaattattgacagcaacaataaagaatatattttgcttgccttaaatagtctaagaactgtttacggaaataaaaaggttattgaaacttacgaaaaaatgaaacatctctataatgatgtaaatatcaatgcacttccagatgttgatttctctgttgtaacggaaagtccgcaaattatgaagtgcgtagacttaatcaataaagcaacaaaagaacaaagaactataaaatttatatatactaattcagcaggacatacaaaaaaagtttttctaaacccattacacacatattataggtggtactcatggtatgtttttggatatgacacctctaaaaatgactatcatatgttcaaagtggtcagaatgaaaaatatttctttaacaaaagaactttttgaaaccaaagataatatagctaaccttttatctgattttgaaaaaagacgcaatcagacaaatattactgttactctatcttataaacaagaaatagatgctttagttaatgaatattttaaaggggaaattgttgaaactgttaatgaatgttttataagagaaattgagattaaagaaaatgattttataacattctcaatccttttgggactttgcgataaagtaaaaatattatcccctcaaaaatacaaagaaaaggtgttagctcatatcagcaaaataaagaaaaatctcacttaatagtgacatacatttgtcactatttctattatataattttctcatatcgaaaatatgaggagatgtgaaaatgaaaaaagtatatgtatatttgttagacgacatggcggaatgcgaaattggttatattttacaagcgttcagtatggaaaaattattaaaaaatggaactaaggaatttgaagtaaagacagtcggttttgataaagaacccgtcttaactataggtggattaacaattattccagattatactatatcagaagttgatttcaacgctagtacagctctgcttttaccgggttcttctacttggggaaataaagaaaatcaagaaatattggaaaaagcacaagaatgtttgaacaaaaacattttagtaggtgctatttgtggagcaacactcgcacttgctgattatggtatattagataaatttaaacacacgagtaattctctggaatatctaagattcttttcaagaaactatgcaggacagagcttgtatgtttgttctaattccgttttagacagaaacttagtaacagcaagttcggcaggttcattagaatggacgaaaaatatcctaaagagccttaatgtatattctgacaagaaagttactgctttttataattattactcgactggaaacgtaaaatactatgatgaactcttaaaatgaaggtggtatttctgtaatgaaacaatcatgggttttatgccccatttgcaataacaagacacgcacaaagatacgagaagatacggaactgataaattttcctttgttctgtccaaaatgcaaaacagaaactttaatcaatataaagcatggaaaagtaactattatcaaagagccagacgcaaagacgcagagccgataatttataggttaatgtaacttgtagattgtcggctcttatttgttttctggtaagcggtaaagctatacaaaaagagaacaagaagctgattacttcttattctccctgctgttcaagataccgtcaatcgtaccttgaataatttttaattcgttatcactcaataaatcaagtgatgtttctatctgacggcgagctgtgcttttgccaactttctctggcggatagaaatattcatcaaggtttattgaaatctgttatgttgtagaatgatgtttttagatactagaaagtgctttaagggggctaacgttatggaaagctttgagtacaattctatacaatcaaatacaatttaataaatctttacaaaaaattgaatgcaatacggctttaaaggctcgtacaaaccatatgttttgtgcgggcttttttagtgcaaataatttttcaaattttttcggtttcaacttagcaaatcacacctgcaattccctatatggtgcggaaagagggataaacacttttcacgtcataacggaaagggggtgagattatgaaaccgtctgacttccagaaaacagttcaatgccgttttgaaagttgtttgaagaaagttgtccgtcatgttgttaaagactaccagcaaggattgaaacgacgaaaagaaaaggaaatttcattttgtgatcttccagaaatcgttgttgaaaagctggctgtctgggacgactacgaaacagattatacaattttcaatgtatgcggtagtgatattcgtgtctatgatgatgaattggcagaagccttgaaaaagctgtccgaacgtaactgtgaaaatttactgatgtactatttcttggacatgagtgacaccgagattgcaaaaaaacagaatattttcagaagtggagtttttcaaaatcggcataactcattggcactcatgaaaaaattactaaaggagaaatgatagcaaatgctacacacatttaagaagccgtcctactacttgctttcgcaagctatggacggggacgaaaaagcgattgaaaaggtacttgcattttatgacccttacatatcaaagtgctgtttgcgtccactctatgatgaatacggtaatgtttatattgttgtagatatggagttaaaaggacttatccgagaagcacttatcaaaatgattttagggtttgatattgccttagaaattgaagaagaataacaagcagtaacgtagagcatgatttgttcaatcccctctttcctgctctgcaccctgcttttacacatgagagcctttataggttttcaccacggttctttgaaaactgaataaagcaggcagatacatttgtgagatagcgagccacggggactttacgccatgacctttctataaggaaagcgagcgacccacgaagtgatccgagagcgaccgttggaaaagtcgctttgccacgacctatgctcacagaataatgatacgtccgcatggtgcggttctgcccacaagaatgggaatagttgagatactaatggagctttccaaagccgtctgcctgcttgtaaaaaacagcacacagtaaagggggtgcatagatgatgaacaatactgatgtgcctatctgggaaaaatatacgctgacgattgaagaagcgtctaaatacttccgcattggcgaaaagaaattgcgtaaattagccgaagaaaatattgacgctggctgggttattgtgaacggcaaccgtattcagataaagcgaaaacaatttgaaaaaatcatagatacattggacgaaatctaatgtcatagagccgtgagtatggtataataaagcatagcgtatcacggctcattccatgacggaaaggagctttacactatgtctaatgtaaaacgaaaagacagtaaaaatcgcaatttacgaaatggagagagccagcgaaaagacggaagatacgtttacaaatataccgatatatacgggaaaccacagtttatttattcttggaaacttgtaccgacagacaagacacctgctggaaagcgtgatgatatatcgttgagggaaaaagaagcaaagattaaaaaagaccttgacgacggtatcgacacaatcggcggtaaaatgactgtctgccagctctacgacaagaaaaacaaccagagaaagaatatcaaacgaaataccgaaaaaggacgacagtatctcatgaacgctctgaaaaatgaccctttgggtatgaggtcgattgataccgtcaagcagtcggacgctaaggaatgggctatcagaatgagtgaaaaaggatatgcctacaaaacgattgacaactataagcgttccttgaaagtgtcattttatatggcgatacaagacgactgtatcagaaagaacccgtttgaatttaagctaagtgatgttctggaaaatgatacagagccgaaagttatcctcacaccagagcaggaagaacgcctgcttgcctttatggaaacggataatatttacagcaagtattatcatgaggttgtgcttctgttagaaacgggacttcatatttctgaattttgtggattgacaacgcatattgatatgcagaacagaatactcaatatagaccaccagctattaagagatagcgaaatcggctactatattgatactccaaaaacaaagaacggaaaacgagaacttccattggcagaaagagcttatcaagcactccaaagaatactaaagaacagagggaaagctcaaccgctgattgtcggtggttacagcaatttcttattcttgaaccgtgagggcttgcctaaagttgctggaaactatgtaggtatgttaagaggactgattaagaaatacaacaagacacacaaagaacaagttaccgaacatcacacctcattcagacatacctattgtacgaatatggaaaacaaaggaatgaaccctaatactctgcaatatctcatgggacacgctaacataaccatgacacttggctattatgcacacggtacatttcaatctgcaaaagcggaactggaaagattggcttgttaatatcggaacgtatatttactactcatttactacttttggttgcattttcatgctggtaaatgccagcttatgcaaggtatcttccaaaaagaaaataccgataaagccctaaaatacgggatatatcggcatttaccaacttatgaaaagataatcagaaatttagtaagtttttattcaaaacatccaattttacacttacatcccctaatcccattaccaaaacaaatcataaaccattcttttatcagtgcgaatccctccatatatttatgttcacttacctttcgcactaccctgtattgttttattataacaccctcccttcaattattccagaaacattttctcctattcccaccccaaaggatactcttcacaaaaatatttttgatattccccgtccgggaattctccttctagtcccaggactctagagtgtgtttaaaaattgctttcgacaagctgtgcgtctttgaccctgatgagggaggcgtagcgggctacgttgaccgaattgggggcaaatataccgcaaagtggggcgtgcagattgtcggaatgaattttcaaacacactctaggccacatgcctgtctccgctgttataaatcccattatcatccccatatgggtgtgcaaatgcctgtgttgtaccaatataagagtaaatcgcgtatacttacacccttccggtctcagtaacagttcttcatcctccagtctcccggtataatccttgattttcttctccacatccccgaaatagacgcttacttctttacgagaaagtgtttttttagtaaccacatccagattatttaaatctttcacatgaatttccggttctttgtactccgtatcatctggatttataaaccataaatccagagaatgcagcatatgatacacatgtttccacaaaggcattccgcaatattccttttcccaaatcgcgtccggaatacacgccatcacatttccaacttcccacaaggccctgtctgctctctgatgacctccgaatatttcccgtactccataactgaatcccttctattctgcatacagtctccgcaccagctcatcatacccggaactgccgtccaatatattcttataggtacttatccagcacggctgaaaccctgcccgaaacgcagcagcctgggacgctgcgtttgaggaggccgcgcagtagataggaaggatatctcttgccagaatatcatgcatcagatgatttacaagcacagatgccagtccacccttacgatacttttccattacatccacaccaatttcccaaactctgtcagattctatggatgctccggcaagccctgcgatctccccgttcctctccgcgtaaaatactatatgtgtacctgttctgcccctctcatcaaacatcagggaattgtcaaatccttttatccccagaagctgtcccagtgcgtccccttccagctccctgtatgtatatcccggcaaaagctctgttctccggttcccttttgcgtccggtatgtaatagatcgactgcccataaagaagaggacattcaaaaatctcctcccggcttttcccggtcagcagctttttggcaattggccggacagacggtgacaccgccgcaacaatggtctccccaagactgatgacttggaaaaatggattctgatacccctctgcccttttccctgcattatggaatacaagacctctctgtttaaaaatctctgtttcgcattctaaaaaatccgccagatgccctttgacaactgccatcatttctatcttatccatctatacctccctatcctatccgatcctatacctcatatcagtgtagattgcctctccatcctcaaatcccaatttcttataaagcccatacccctcttttgttgctttcagatccacatagcttaggtccattttctctgcttttttcagcagcatctccataagctgcccggcaattccctgtcttctgtaagcaggctctgtataaacattgagcaccgttccatttttaccgctgatacagtcaggctttgccggacgctctgtcaccagcaaaaaagcggacgccgccatttccccctgcgcatccacagccacgaacacatgaaggtcacgccccagatgccgcgcaaaatattccggcagttgtctgcgtatggcctccgcagatccgtgttccaattctccatgctcatccttcagatatgccattcttatctccgtaagagcttgcgtctcctcccggtctgccatcctcagaacaacattccccataactgtggggcacacatatttttctcccggaatctctattctgtccctgatagatatctgctcctctgtcattctatactcccagctcttttttcagatcttccgcgtactttttctgctgctttttcagatacatatttgcagcaaatttcataaacggtttcttcatctccacttcttctgtaaaatctatctccgttccgttaccgctctcccgaagcagaccagtccaatggcccctcatattttcattttccatatcaaattcataccggctaaacggcaccttcctggtgatggtaaaggtggttggatatccgttttttgtatactccacaaaagtctttccgtcacccatctcttcgatcctgctcagatcactgcgccagttgtaattcttattatccgtgatcaccttccaaacctgttccgcgctggcggacaggtggatcttcatatttgcttttgccatatctgcctccgtttacacttttttaccagtctaccgcctgccgtcctccttgtcaaatcagaactggttttcccacaaaaaaagcgtctgcctccgttttccggatggcagacgccgaaatattttagtacaagatcacatcaccagaccgcacacaatatacagcactgtggcaatcgacgctgtcaccagcgcatagggaagctgtgtcttcacatgggagaacaggtctgtgcccacggacatggaggacaggatcgttgtatctgaaataggagaacagtgatctccgaaaataccgcctgagacaaccgctccgatagccagcagaatattggaatccatagcaactgccataggaatggcaattggcatcatgatggagaaagttccccagcttgtacctgtgctgaatgccataactgcgcccagaaggaatatgatagcaggtccgaaagcaccgctgatccttcctccgatcaggcttgcaaggaaggtacctgtacccaatgtcttgatcacaccgccgattgcgaatgccagtaccagcaggataacaagcgtgagcatattgctgacacctctcagcacataatccccaaactgttttccggtcatgatcttctgccttgtatagagcacacccataacaagcagtgtaatggtaactgcatagaggatggaagtagttccgtcaccctgtgtgatgtttccttttcctgtgataagcaggccggtgaaggttccgccgatcagtacgataagaggaagcatcatgttccatttattctcttttccctgctctaccagctcatcaaatccttcactgtcgtttagcagaggaacaacgccgtcgtcatacagcttacctgtagtacgcacacgttcctcagcctttttcatgggtccccagtcttttccgcttagtatatagaacaataccataaccagagatacaatactgtagaactggaacggaaggctgcggatcagaagattcatggggtctccggtgatcacgcctgcagtgatctctgccccgatgagtcccatgagcatagcgccccaggagttcagcggaataatggcattgatgggagctgatgtggagtcacagatataagccagtttttctctggaaactttatatttgtcgatcagtggtcttgtcacaacgccggtgaacatgatacttaaaagaccgtcaatgaaaataatgataccgatgatataggcgatcatcatagccatttttttactttttaccttattgccctgctctgtcagatacgtcacaaagccattgacgccgcctgacacacgcaccagaataacaaatgcgcccatcaatgtggtgaacagaaatgttttcaggttaccagtatctgcgcatacgctcaaaatctggttcaccatctcatttacagcggtgatgggattccatccgcacagaatcagttctcctgaaaagataccaatcagcagagcaagcgccaccttccgaaacgcgatggcaaatgcaatggcaatgattggcggaattaatgtcaaaaaaccgtaatccataatagtccctcctctttcatgtcaatactgggcaaacaaagagccaaaacctcctgtatgcagatagcagacaggcccttttgtctttcccttttccagccagtccctcatgccgaccagaactttactgttatagatattttcaataaaaataccctctgccctggcaaattcaaagatttcccgggcactctcgctggtattcacaccccagccctgtccccggaaaccatcctcaatactgcagagctcttccacaggtttccctgcgggtattcccgttatggcctccacttcccccacagtatccgcaatgtgttttctcaggttttctctgtcatcctccacacttacgataacgatacggaagggattccccataactgcattcccatacaccagccctgctgccacgccgccatttccgcccggtgcaaaaatggtcatgccgctgatgccctgcctccctgcactgcttcataagctccggtactgctgccgtataacccagagcacctcttcctgtggtcgcgccatttctcaccacatagggatttctcccctctttgcggtatttttcaaaaagctcttccacaaaagcattgcggacatctgagtccacttctcctaggaaatgggatttcactccgaggatctggttcagcaaaagattgccctcttttttctccggctctgctccattgtggaccaactcacagtccagtcccagcttagcgcaggccgcagcagtcagagtacatagattggattgggcgggtcctgcagccaggatcactctgcttccttcttttactgcctctcccagtatgtattccaggcttctaatcttattgcccccggggccgatacctgtcatatcatcacgtttgatataaatgtctctgcagccccattgctcctccagcctgtgcaggcggtgaagcggtgtgggtgccggcatcagcggtacacgttctgtcttctccaaaaaagtctccagcggacgcatgcttctttccccctttctaacgctcagcgatcacctcaacttcacagagtaccccctttggcagcgtcttcactgcaacacaggaacgggcaggattggtggtaaagtattttgcataaacctcattaaaagcggcaaaatccttcatgtctgcaagaaaacaggtggtcttgatcactttttcaaaactgcttccccctgctgcaagcacctgacccacattttcaatagactgctttgcctgagcggtgatctctgcctccactacctctccggtagccgggtcaatgggaatctgtcctgaagtaaacaaaagtccacttatcctcattccctgtgaatatgggccgattgcagccggtgccttttctgtactgataatttccataatttcagtcccccatttctctgtcgttttatcatattaaagagtatatcactaaactattttttagtcaatagatattttttcattcttttacgattttgaatgaaatatttttcagtccaggttgcgtttcccctgcaaaaaagttataataggaaaaaggaggatcttaccatgaattaccttatccttacagaaacagacaaagcgattttagaatcatataagacagtcctggacggacttgcagaatatttaggagacggatacgaactgattcttcacagcctggagaatctggaacactctgtcataaagatcattaacggccactacaccggacgtgtggagggcgcccctatcacagatctggctttaaaaatgctggataatatccgtcagaaaaaagagccggctgctctttgctattttaacaaaaagaacggcaacaccttaaaatccgccactatcccaatccttggggaaaagaaacggatcatcggccttctctgcatcaattttcacacagaggtctcctttgccagcattctggcaagctttaccccggcaagcagcatcgtccccggtgtgacagagaccttcagtgacaacgtagatgacctgatcacctccgctctggacgaggccaagaacaaggtatacgccaaccccatgatctccaccaccaataaaaataaggagatcatccatctcctgtacgaaaaaggcatcttcaatatgaaagacgctgttattaaagtatcggaaagcctcggcatttcaaaaaatactgtttatctccacctgcggaatctggaaaaggaaaataatacataaagaacctttccatatctgcctgctgtcatgtaatcaaaaagtgccggacagaaacttttgcttttctgcccggcacttctattatacccttataccctctattctattatgctctctgttctattccagaacctctgtcttctttttctcattccttttgtaaacagtaccaaatatccccagagataccaggatcaccgctgccataagaatactctgaatggtggagtaaaaagccccgcagaccacagcaagacacatagccagcgcaaagggaaccacagctactttcaaattcttcataagtaccggaatcacaagcggtcccaccagtgcgggaaagatattgtcaaaggccggacttaccaccggatttgtaagaagcggcgtcatgatgggcgctaaaaacagcattccgcaaaatacaatgacggtagtgacaaaggaggatgtggcaacagccagaatggataccacacgtcccttctcgctcccctcttcacaatccataatgcgcatggcatttaacgctgccgggagcttcatattctggatatttcccgtggaagaagccaaatatacggctcccggcccgatgataggcgccatggacaatttctcgcagatacctgtgatcatgaagataagcgcaatgggcgctgccaccacgagcatttccttcacattgatattcagtttgaatacggcgcagaccgatatgggcaccagcagaaaaaacgcccacacgatcagtgttgtggtgattcccaggttatgtatgcgattgttaaaggaattcccctcctgcggggaggatttcatttttttcatatctgtgttcctcctatttgatcagacttgtcaccagacaggccattgccataccggatatcatactgattgaaaacgcaaattcctttagctgcttccatcgctttgacatcctgtccattagtaccatgaccacagcagacaccgctatggtggagagagagaccacatttttcacatccacaagataaggggctgccagggttgccatcatacccaaaaacataatgttgggtaccagcgcgccaaaagattttttatttgtggtgatactctgcatttttttatcatactttttcaggaccagcgcagacatactggataaaaagactcctagtgtcaccacccacattatagacccgaacacatccggggaaaaatcagcgcttccaaggctgctgaacccataagaggtgactgccatattagccgccatagtctcataggtggcggaaccgataacgcttaaccgaagccagggaaagtatttcccgagggccggcagtaagatcatatagctgatgatgatcggaagtgacggcacaatggaaaatacggtgctgctctttaccaccttcagaagatccgcttttgtgaatccaatgcggatggcctccttccatgctgccctgaaaaagatagctgcctggacaagaaccacaagaatagccagtccgcatataaaaaacatgacactgctgtttgccacaaaagaatactgtttgttcaaaatatttccccctctctcaaaatgcccctgcctgtacttcagccgggatcacgctgtgatactcaaatccgttcttagccttttccatatcttccctggcttttttggctatttggggattttccattatatccagtgttgttctggcaatgaccgaagccgcagcctccatacctctttttgcgatccccgattttccctgggccactgccagccaggaatgggcaggggttcccagggcgtaacaggcacttccaaaccaggcagtcggcactgtccagctcacgtcacccacatcggtagagcccatcttgacaggaaccggaggaaatatggtatccgccatggctccccggaaaaacgcatttcccttttccccataaaactgtttcgcaagcccctggtatgtcttccagtcaccggggtctcccaccttatggaatttctctgcgcaggccatctcctcctccgtatatttcaacggatagatttcccggatatggctgaacaccaactggtccagtgtcttattctgcaggacatccgaataggcactcaccactcggatctccacctttgtctctgtcatcatggcagcaccctctgccaccttgctgacccttttgatcagcttatgcagctcctcagttcccggcgcacggacggaataaagtacctgggcataagccggaaccacattgggagcctccccgcctgaattggtcactgcatagtgtacccgcgcctcgggtatcatgtgctctctcagataattgacccccacattcatcagctccaccgcatccagagcgcttctgcccaaatgcggtgccgccgccgcatgtgcgctcacaccatggaagtcaaagaagatccgggcatttgccagcgtggagatggagctgaaattggcagaatagggatgccaggccaggcagatgtcacatgcatcaaaacagccctccctcaccataaaagctttgccggctccgccttcctcaccgggacagccatagtagatcacagtgccgtccattgggtttttcatgagataatcttttaccgccacggcagcttccatacctccggtgcccagaagatgatgcccgcagccatgcccgggtgccccttctttttcaggcattttttcggtcacatccgctttctgggacattccgggaagggcatcatattctcccaatatgccgatcacagggtgtccggatccaaactttgcacaaaatgcggtctctattcccccgattccctcctcaatgtcaaagccctctgtgcgcaaagtctccatttgcagcccggcggactgcttttcctgaaaacgtgtctccgcaaactcccagatcctgtcactgatattttcaaatactgcccttttttcctccagcagtttgtcaagcatttcatatttcataagatatcctctcgtttccggcaccgggccttttctctttttctttttttacaagcaaatcctctccattggcgggaagaagtattttcatcaaaactttgttccaaagccttggcagatccctgcgctctttcgggtcaaggccatactgaaaagctccgtttgttttttcatcaaataatacccgttcaaagggtaccagtctgcagtcatagctttcatcctgtttctcctcagcaagtatatagacaggaagaagccggaagtcatgtatacggcaggtgcagtctgtactgcctttttcatatcccttggcgatcctgaactttaccacataggtaagcttggagtcttttgtaaggggatgatagctcacaaaatcacccatggagtacaggataagacttcccttatagttttccatctgctgacacacatggggatgtcccccgattatcacatcaatccccatgtctgccagtttgtgaccggcctctatgatgtttttatgaggatacagttcaaattcccagccccagtgaacagaggcaacgatcacatccgcgcctttttcctctgccctctttatatggcgttttaccagtgaaaaatcaggttctctgtcattaaatctgacctcattgatcagcgctttgttatcatagtgattcccattcatatcaaaagtgtaagacagcatagcaatgcgtatgccgttcttctctatgatcagcacatcctcctgttccctgctgttgcggttggtaccggaatgaaagcatcctctcctttttaaattgtccagggttgtgtacagaccttcctcgccgtaatcaaagcaatggttattggcagtggaaaaataattaatgcctgctcctccctgccagaaacggtccagcatggactcagaagtattcattttcgcaggcattcccatcacctgattcctgcccagaggtgctttgtcatagactgtggattccagattggcacaggtaatgtcagcgccaaaataaaaatctgcaatttcatcaaacagatggggcgtattttcataggtcaggcagtccacagccatcagatcccctgctgctgacagggagatttctgtctgaacctgaaaatcctccggcagggagaattccattctatgttcagaaaaatacgcctcgatccccgaatgcttttctgccgtctcaagctggtgcacccagcagcggtatgcccatttcagtttctaaaatgtgttgtctgccacatcatacacatcctttaccggctgtgggtacctgaactgatcccacatcaccacactggctgccctggcaagccactgaatgggttttgatgttttatatttcattttccctcctgctttctctgtctttcggcctctgccgcttttctgatcacagtataactttacaaagagagagaaaacagggcagataaaataacaatagggatgtttttgggtcacttttcagaaaagaaaaaaacagattaaaaaaagacgtcctttttttaatctgtttcccgcctgataagaaaaacggcaatggcgttgagtgtcagggactgatggatctcatatctgccgtctatggactcctccataagagagattgagggattgcagaaattttccaggtattctacaatgtcatcctcctccagaggattggaaaaattcattttgagccagttattatagagactgccgttgtcacggtccagccgtatgcttttgatccggtagcggcccgcagggatattctgcagaaccagatttacattttttatgtttccgcttccccttacattatccagagaccgaaaggggtctatataacagggatgatacatgagaacagccagagttcctcttttgtccatggtcactaaaatatggttttggaacatgagcacctgctgtttcaaaagcatcagggagcggagcgtaaaaaacagcagcctcctgatattattatacaaaaacagactcagcggataagacaaaagcgccggcatagggttctccctgctggaaagattcagggcaaaggcaattcccgctgtcatctgagccaaggaaaacaccatatccgcgatcagagcggtcctgtgaaactcacctgcctccacctgggattttcccgtgagtgtgttaaagtgagttaaaaatataggcagtctggcccctgcttcctccatccagcccttcacagcctccagtcttctgtgatggcaggttctgtgaaactcctggtattttaccgcgtctgcaggggccacagactgattggggtctgaggtgaagctcagaaaatccacaagcagcaaaaactggttatgcagaacaaattccattttctccacagggtaggggtgttctcccacaagtatacccgtcctgaactgggaacagatctgctttatcatggcagccgcctccagtacaaaagacagttccctgtccggcgcacagagttcaaaatgccactgttccagatattcctcctcgaatctgccgcatacaatctccaactggcgcttcatacgccctaaaatgtactgctgtctttcccttttcataccggcagcctctgttagctcgattctcacaaagggaaccagccccatctgtctcagattgtttatgatctccgtacattgaaagtaatggatcagctctctgtccggtacgtcatccttttcaaagaaaaagccatggaacatgacatattcaaatccgatagccttctgtgcctcccggatctgcatctgcaccgtgctctgcagtgccgacaaaatatgccctatatccagaatcttcttaggaaaatccacctggaaccgcttggctgttctcacattcaagacagcgcgctccggctctcccatgtctgcctccggttcaaagcggcttacatagcgcaccagcgcctccagggattccggggattttgcccggccccctttgtcctgtccgccggatgtcctggtacctgtcttttgtgccagcgcatatttcttcctgtattcacccggggaacagccatactttttcctaaactggctgttaaaggtcttgactcctgaaaacccgcagttcatggcaattctggtaacaggctccccggtatagataaggtcgtgcaccgcagcctttaagcggatgcccgtcagatattccagataagagactcctgtttcttttctgaataatttggacagatacggaaccgacagataagcctcccctgcaagctgttctaaagtgatagggttcctgtaattctggctgatataagagagtatgggatagagctttccatcccgggatatatcagtcatctcatatgtttccccggaaataaaatggtgcagcagagtatgcagcaccagcaataattccgattggaaaaggagcctgtcctcctcaccctgttttaaatagataaaagccatacgcgccactctctgcttcagggattcgtacagggactctgtcccggactgcgccctggccgtactgcaggtatagcggtttttcagtatttccgggcaacgggtgctcagatattctccggacacacgaagaaacagcacgatattctgtccccggctctccatcgagtacaattctctgtggttaatgactgccagactgttgctctctaaaatgccggcttccccaaaggtctccaacaccacctgcccccgcaggacaagaagaaaggaaagcccgtcattcaactgatggctcaggctctccatatggtctaaatatacctgaaagttatccattccggctctcctttttcatatccgatactatcctgcattacagaagcagattcagcagcccgatgataaacccgatcaatgctcccagattgataacagcattcagctcttttttcatgatggacatgaggatattttccacttccagcacatccataccgtttaccttctcttccactactttggcgatgtggaactgttctgccagttctcccgccttgtcacccacaaatttcacgtagatgctctccaccagggcgcggatcttctcttcacccagagggatggattctatgagttctccgactttgcggctctccacagacgcgatctctcccactaccaccggatggatcttgtcatgcccgttctctctgatataatctcccacttttcttccaatgggttccgcaatggaattgatcagatcatctgtgagaaacatggataccatggagccttggaatttctgctttacttctttggcgccttcctctgcaatgatggagcctacatccagcttgtccaggccttctgtgatgcggtccgtgataaaatcctccagcttttcccgcatcgcttcatagtcgccctgttccacatagtgctgcaggaaatcttcaacggtatcatcgcttttctgcaccttctggacaccctcgctgatacggctgacaatggtatttttcacaccctcggacagcagcatatcctccagatccgtcttcgtgatcagatgatcccccacagcacttcccagcgcctttgccagtctgctttttcctctcgggataatgcccggtgtaaagggcagtgtccagttcccgatcttcaccgggtacagggggcgaaacaacatcttcactgcaatataattcgtacagtagccaatgaccgctccaatgagcggcccggccagtaaacgtaaaaaattcatctatatcccttctattcgttgtgttcaatcatgatcttcagtatctctttgtctgtctgcttcatgccttccttgcctatgtatcccacacagctaatggtctcaggggtatcctcctgcaggatccctgtgtaaggggcatagactttgttcttcatagccaggttatgagccatgatggcagcgtccagactggtggcgatcttggccgcacaggagattttcgctccatcgcagataatacccggtatattggccagtgtattctccactgtcatcttgatctgatccagtgttccacccaccatataggtgagagccgcaccactggcacaggacgcagacaccgcaccacagaaggctgagagcttgccgatataagttttctggtaaatggtcagtagattggaaaatactaatgagcggtaaagtgtttcctgatccacctgcttgatcctggcataaaccaccacaggtacagaggatgcaattccctggttgccggaaccggaattgatgatgaccggaaggtcacatccccccattctggcctcagagcctgccgcggcataggccttcatctgattcagcgtggtgtcaggataagactccaccagaagctttccaagccccagtccgtatccgcctttcattccctcattggctatggccatattacaggtgatctgtctctctattaaatgctgtaccttggaaagctccaccgtatcagcaaattctttgatattttccatattcaggataacttttctctcatccgtgtcgtcatgctcaaactttgcggcgccttccagcagttcttttccgtcttttcggatactggtgatgttggtatgtccgtcacggatttccaccactgcgctgtgttcctctgtatacagctccagaataatatggagcacactgggactgtccaaaaattccaccttacagacaccttttttcagcatttcttttgccttctcaatatccgcgtctgagacatcctccaggacctccatctgcttcccggcatttccgccggcaatgcccagaagtacgccggcctctatgccaaccagtcctttggaattgggtatggtgacacagcgcacatttttaatgatattgccgctgcacttggcgatgactttttcaggcatcccgcccaatatctctcttgccctggcaccgccgtacgcaagcgcaataggctctgtgcatcccatggcaggaaccagttcagattccaggatttttatataatcttctatcatttcatttgtcatcatttttaccctctcccaaaaaattttccgcgccagttcccccacatgcggatcaaaaagtattcataggccttgtcaaacaaaaacagggcgatctggcctcccaacaggaaaaacagcagcactttatctgaaatcacacctgcaaaaagcagttttggaaacaggaaaagtgcaggcacatacatgatattaaagatcacgaattttcctgctgtaaaaaccagctttggttttttcatattctggtgctttcccagaaaacgccacaagccttccacaaaaagtacataggcacccatcatggcaaacgtaatgcaatagagcttctgaggcgccagaagaaatcccagaagcagagttcccccgaaaaatatgatccctgtcttgaggtcgtattctctcacgataatgcccacacagaaagctgctgctgccagaaaaaacaaagtattaaaatccagaacaccgctgagtatgatcataaccaccgacaaggccatcaaaaggccggatacggccattttctttccgcttacatgcatggacaaagatctcctcccatacactcacacaaactgtcagcgcaccacagatcacagcagaagtttcccgtaccgcaggaagagccgccgttgtttgcgtaaggactgccgccaccctggtatctctggctgttccactgcaagcggttcaccaggttggaatactccggattgcccggttccatggaagatgcctgtcttgccagattcagggcatttacattgttacccattcccatattggccactgcgctcagataataccactgggcgttcctgttctgtatacgggaaagcacattgagcgcctgctggtactggcgggcgttcagatagttggctgctgcctgaagctgcatattgtcttccgaggacgcataattctgctggctgtatcctccggagctgtagctgctgcctgtgctgctgccgtaaccgctttggtagcctccgtccctctcacgcatgatctggtcataggcctcctgtacttctttgaacttttcctctgccagccctgccagcggattatccacataggaatcgggatggtattttctgctcaaatcccggtatgctcttttaatttcgtcattgctggcgttttgtgatacacccagcacttcataaggattgttgatcatggttctcttttatctcctgtctttctttttttaatttattatattttgaccagactcctgaatagataatattccggagcagttcagactccttaatacagggaagcttctcaaaggcaccgctggcttcagccatcatcatgagaagaatgtcatacacttccctctcatacccttccttatcctcttcatacgattcatagagagttttcagcgggttatagctgcccttttttatatctttttccaggtcatcataggcatccataatatatatgaacttcccaagatagaaaccgaattttctcaaatattcttcccagacatcctcccggataacaaaaatttctgccatcagctctccgaaacagccggccaccagatccaggtccgtctcttgctgcttttcatactctgagagtctgccaagctgctttctgatcactttactctgtctttggtactcctgacagatctttttagcttttttcttaaataaatgaacgccagtcagccctttcatgctcttatcatcctgccagtcgtctgcaaaatggtaaaaggaaagcagaatattcatcttggctccgtactgtgtgatctcattctggagcatggggatcttctttacagggtgcaccgggcaccgggaactgatctccctggtctcactctcataaagagatgtgagaagcaccaccagaaatgtcatatcatacgtaagggtcattcttccccgaaatccgtattcctctttgagtgtcctgcaaagaccgcagtaatatgccttgtactgataaaattctttcactttcagctccggtttgtccaccgtcacatatccaaacatatgatttagctgcctttctcctgcctgctgctgcaggtacttacttcttgacataatctatattattatactataagtttctgcaaaatactatccccacattgacgtaacttcattttttcgatatactaatatactgaagtaacggttcaaacaggcctgcgcacttactgcgccagccatatgaacctatattatcggcagatatagggctgtcacgaactgaaaaaacacgaaagaaggcattttttacagatgaaaccggaagatatgaacattcctccccaggaatttgatgtgcgttttcctgagcggtttataaaaaatacagattactacaattctctcatgatgatgtaccgctgtgccattcgggagatacagaccaaactggaggtgctggatgatgaattctctgtaaagtacaaccgcaatcccatctcctccatcaagaccaggatcaaaaagcccatgagtatctacagcaagcttcagaagctgggctatgaattcacggagaccaatatccgggaacagttaaacgatgtggcagggatccgtgtcatctgctccttcatagatgacatctatacggttgccaatcttctggctgaacaggacgatattaagatcatccgcatcaaggattatatcctgaaccctaagcccaatggctaccgaagctatcacatgatcgtagagattcctgtattcttcgcagagggaaaaactcccatgcgtgccgaagtgcagatacggaccataggcatggatttctgggccagcctggaacaccagctccgctacaaaaaagagctgggcagcaacaaagaccatgagcttatcagcatggaacttctggaatgtgcccacaccatcacagcggtggacaaccagatgcagaatattaaaaagatgatcggggaactgaactgacgagttcctcgatcatcttttatttatgataataggaagcccccagtgtgtgctctctattattcagcgccggaaacaaacttgtcaagaagcgtttcacaggcatcatagtaggctgtcttctcttcattcttctccatcttggttccttccaggctgcgcattgccacatatagatccttcacggacgcaggttctcccatctccgcataggcagcacagtcctccaccttggcaaagtcctccagtttttccggaaaaacaccggcgtccttgaacttttcaaaattctgctggctgataaagaagatcatgcttgtcccttcctgcagatccactgtcatcttcgtctgtcctgctgccagcatctggggatcatatccctgggcatcgtccgggggcagtacatagttctggatctgtacatggacttccccgtccccgttcaaatcctctgcattggcctcaaaataactctgcagagcctggctgtcctcgtcagctatcatataatctgtgacaaaggcaatgtcataatcatagtctactttgctcagcatatccttgacaaatacgaccaccataaaaagcaggaaggccccgatcagtacatggaacttataatagtaccaaaaattgtcaactttttttcttgtttcgtctttcatctgtggtttcttcatttattcactcatccgtcctttttttgtgctgatttagattttatcacttctaaattgagaaaggaagaggttttataagactttatggagattttagaattacggctgttcacagcaaagactgtaacttatggcttgctattttcctgacttgtgatattatggtaaaggattttcagaaatacaattaattggagattaaaatatgaagaatctgactcagggaaacccaaccaaacttatgctctcctttgccctgcctgtgtgtctcggcaatctgttccagctcttttacagcctggctgacacaaggatcgtgggaagcacactgggggaatcctctctcgccgcagtcggcgccaccacagccatcagcactctgctcatcggctttctgcagggtctgaccaacggcttttccatcattgtttcccagagcttcggcgctgacaaaaaagaacggctgaaaaaagcggctgccggaacctttcttctgggctttctcaccacaatagtcctcaccgcagtctcccttttagggctgaacggatttttatccctgctgcaggttcccagccatcttctctcggaagcatcagggtacataaggatcatacttatgggtatgctcatcaccatgctctacaacgcgctggcggggatcatgcgggccgtaggcgacacagtggcacctcttctgtttctggtctgcgctgcccttctgaacgtggggcttgatctgctgttcatcctgcagttccatatgggggtaagaggtgctgccctagccacggttctggcccagagtgtctctgttgtactgagctttgtctatatgtggaaacgctatccggtctttcgcttaaagcctgcagacttcaggctgagcaggaccatgataaaggtcctttactcctccgggctgtccatggctctgatgatgtccctggtatttttcggtaccctggctcttcagtgcgctatcaataccttcggcacggaaatcattgtggcacatacagccgccagaaaaatctgtgaattttatttcctgcccatctccgtcatgggtgtgaccatggctaccttctgcggacaaaatttcggtgccggaaaattcgaccgggtaaaaatcggtatccgccaggctcttttcatcacatgggcatggacctttgttgtcatcttcttaagctacacagcagcccccttcctgatccatctggtcacaggaagcagcagcccggtggtcatagaaaacgcctccaaatacctgcggataaattcccttctgtattttgtcgcctgcgggatcaatatcctcagaaatgccctgcaggccattggggatcacatcactcctgtcatatccagcttcatagaactggcgggaaaagtgctgatcgcgctgtttttgacacctatcctgcagtacatggggatcatcattgcggagcccatcatctggtgtcttatgatactgcccctgatttttaaattccgccgtctgtgcaggacacaaaatcaaagacagcgcatataataatcataaagcgattcaaggagtcaccatttggcatataaaattgtaatagacgccgggcacggcggaacggatcccggcgctgtctataagggcagacaggagaaagatgacaatctccggctggccctggcagtaggccggattctctcccagaacggggtggatgtggtgtacacccgcaccaccgatgtatatcagacaccatttgagaaagcccgcatcggaaacgacgccggagcggactggttcatctccttccaccgcaactcaagcccccagcccaaccagtattccggtgtggaatccctggtctatgacctgtcgggacaaaaggttgacatggcggaaaacatcaacggagccctgggagaactgggctttaacaacctgggcgtgagagcaagaccgggcctggtagtccttcggcgcacacggatgccggcggtattggttgaggttggttttatcaacaacgacaaggacaatgccctgtttgacgagagattcgatgagattgcccagggcattgcctacgcgatcctgggaacactggaggaggaagaggtggagaaaccgcctgccggggaaccggtgctctaccgggtgcaggttggcatgttccgtgaaaaacaatatgccgataatctgctctatgaactgcaggaccagggatttccggcttacattttaaacgaagacggcttttacaaagtacaggtaggcgcttatcagtacctggcaaatgccgtcaggatggaacagaccctgcgccgggcaggatacagtacctggatcaccacctgataaaaagggggatgcctcaccggcacagaataaaaagccggtatgaaaaaagatgtcttctgctgtatggcaaggagacatcttttatttatatcactgatacgagcattttctcacatggaatctgcccgctcttccacattctttttaaaattgatcacttcatggtcatattccccgctcataaactgggagtggatcatgaaatccgcagtggccttattgatggccatggggatatcatagacctgcgcaatacgcataagagccttcacatccggatcgtgaggctgcgcggtcagaggatctgagaagaacactacaaagtcaatgacaccttccacgatcttggctccgatctgctggtcaccgcccagaggaccgctgttgtatcccttgatgcgaaggcctgctttgtccgcgatcagcctggctgttgtgccggtaccgtaaaggctgtgattcttcagtatatcataattctctttgcaccattctatcagtttcggcttttcattgtcatgtgcgatcagcgcgatatgtttctttttccctattgtaaatgttataaattcgttgtccatgtatcttaactcctttcagctatctgtatggtttccggttccggctgctgtttacaggcctgcccgcggacagtgaccggttcctctactgtttttttatcataacatattttacttgtcctcacaacgggaaactgctacaataattgcaaagaaggagaagcctatgtactattttatcatcaatccccgctcccgttccggcaaaggacaggagatctgggacaatgtcaaaaaacgtctggatgaagaacatctggaatatgaagcctattttacccagcggcacggacatgctgctgaactggctcatcagattgcagccctctccattccctgcacattggttgttgtaggcggagacggcacagtgaatgaggtggtcaacggacttgtgaaaaccgtgtacacccatattaccctgggatatatccccacaggttccggcaatgactttgccagaggccttgggcttaccaaagatacagacaaagcagtggaacagatcctgtcccccgcatgtattgagaagatggatatcggaattgcgcggtcggatggggaaaagcgctgttttctcatcagcgccggcattggctttgatgcctccatctgtcacgaggctctcaattccggcctcaaggattttctgaaccgataccatctgggcaagcttacctatgcggcaatcgctctgaaacaattgtttctctaccgcccctgccgcgtggatatccgcctggatcaaaaaaacatattgcgcttcccccgctgcttttttgtagccggcatgaatctgaagtatgaaggaggaggctgtaaattttgtccggacgcagatcacacggatggaaagatccacatctgtgttgccggaaagctctccaagctgaagatcattaccatgctgcccactgcttttattgggaaacacacgtggttcagaggcatacagatagaacaggggcatgtggtggagatcatcagccagcgtcctctccctgtacactgcgacggagagtcttttgggtttaggaattccctttccctcagaaccgcccgggaacagatttctgtcattaccagatagctgaaagaaggtttaacttatgaaattactgctgataactgctgccattatacttctcgtttttttactctacttctattgcatcatgccgcgttttacaaggaaatcccagacccgcgcctttatgcacaggctttttgcgcacagggggctgtttgaccccaaagaaggcataccggagaattccctgccggcatttgagagggccgttctctgcggatatcccattgagctggatgttcagatcaccaaagacgagaaaatcgtagttttccacgactataccctcggccgcatgtgcggcattgacctccctctggaaacaaaaacctatgaggagcttcagcgactttccctccagaatacaggcgagaagattcctctcttttctgatgtactgaagcttgtggacggacgtgttcctctgctgatcgagataaaacttcactctcaccacacatatccctgccttcttgtggataaactgttacaggggtataagggcagctactgcatagaatcctttaattccctggcccttttctggtaccgccgcaatcggccggatgttgtgagaggacagctctcctccaatctcacaagccctgtggctgagggtggatatgtactgagctttctggtcaaacacctgctcaccaactgtatcggccgtcctgacttcattgcctactgctataaggacagccggaacctgagcttctgcctgaaccgccatctgtacaaaacacctgtgtttgcctggacactgcgcacaccggaagcctacgaaaaatacaaaaaacgttttgactccgttatttttgacagttttcttccccgcagacaggcatgaccagatgttttttccagagtgtgaattggatgtgaagcttttctgaatttactgtaaatcccattgttatcctgattttcctgtgctataattggcaggacaaagaaaggctttggcatcgaaaagaaggtgattaagtgaatctggttaaaaaatacaaacatacctggatcatcccagtatacggcatcttttatcttgcggcattccaatacctggagcagcgtgatatccggccccatatcatccatatgaagattgatgactatatccccttctgtgaatatttcatcgtcccgtatctgttgtggttcgcctacatcgcagtgactgttttatacttctcattttttaatgacagcaaacgggaattttaccaactgatatttaccctgggagtgggcatgacactgttcctggtgatctcttatatttatcctaacgggcaggacctgcgtcccaagctttcgggtgacagtatcttcattgaactggtgaggcatttatacaagatcgatactccaactaatatactgcccagtatccatgtatttaactccgtggcctgctgcacagctgttttcaaaaacgcaagagcaaaaaggcatcccctgctgcttggcagtaccctgcttctgaccattcttatcgtgatggcaaccgtattcctgaagcagcatacacttgtggatgtagttgcggcatttgcgctgaatgttttctgttaccagatgttctacaaggcacatcctgcacggcagaaacagccggcttttgtaaaatagcttttaaaattttcacaaaaaaaggacactccgcttttggaatgtcctttttttcatactaacagcgcctccgtatggcgacttctttcattcttttgactcttgatttttctttaattgaaaccatagaatttctgcactactttatagatcgccacagaaatatttcttccgctccatcccggcagattcacgcttctgcctaggatacccaggcggagcttcctgtaaatatggatatcttcatttctcagatatttccacaaatcctttttcttttccaaattttcctccgtgccggagcgtatcagcataatagaggaaaccgcggtgataatgtccaggtaacggaggagatactgccgcagatgcttgtcactgaccctctttcccgccacagaatcgatcatgagacggttcaccaaaagctgctggtcaattctgcgtatcatcacgtcctcatgcactgactggtcctccctgccgataaaatatcggtaaaaattcacgtccatatagtacatggtcttcaccgaaggcagcggctgatagacaaacaggttgtccacgtaaaaggtgtgtttcggcagctccagaccgcactctctgagcagtccggtgcggtagatcacagaatgcatcagaatatattttcccaccggcatcttgctgatctcctcccaggtaaaaatttttccctgcggaaggtatttcttatagcgcatgactttcttccgtctggcgccctgcttttcatagacaaaattgctgatcatcatatccagggtctgaggccctcccactatctctgagagctttgtcaggatcgcctcataagcctctttgttcacccagtcatcgctgtccaccactttaaaaaagattccggtggcgtttttaaggcctgtgttcacagcctccccatggccgccgttctcctgatgtatagcctttacaatgcccggatatctggcggcataatcgtctgcgatctttgccgtgtcatccgaggaaccgtcatccacgatcagtatttctacctgatccccgccttccagcagggaatccacgcatttttccatgtatgcctgtgaattatagcagggaactgctacggacaataatttcatttaattagtcctcctcaatatattttctgtatgcggaaaaagcggagggaatcgcgtattttcccttcgactcttttttattgataaaaagcaggtttcctgcctccttctcttctgtggaggccacctttaccacatatcccttcatatgccactctacatgtgaaaaaatatgttttgcctcgcctgcagttcttatgtgcaggggtatgagtttccattcctccactgccctgatcacttcctcctcggtcagccatccttccacattgggaaattcatacaggccggccaaaagtccttgatcgggacgcctgcatatggcatattcctgcccgttctgtatgagaaggactgtcttctcctcaattctgcgtttctttttggaggcttttttcggatattccaagacagtgccattggcccgggccttacacagatggcttaccggacagtcgctgcacttagccataccgttcggtatacagacggtagcacccaactccatgagactctggttaaacgccccaggcctgtcctctggcatgactgcttccaattcctgttccacccgcttctttaccgactgctttaagatatcgtccccattttcagtaatacgggatatcacccgcagaacattgccgtccactgccggctttttcaggccaaatgcaatggaggagacagcgcctgccgtatagcttccgataccgggcagtgccaggattttctcataatctgccggaatctctttattatatttcaaaacgatctcttttgccgccttctgcatatttttcacacgattataatagcccaaaccttcccacaatttcaacagtttattttccgggcaggcggccagatcttcaataccgggaagcgccgaaaggaatctctcgtaatatccctttacagcctccactcttgtctgctgcagcatgatttcagaaacccacacgtggtagggagacgggtctctgcgccagggcaggtcccgcttattttcctcataccaggaaagcagaggttctgttatctcttccagtttcatatcagctttacctccaccggttccccgagtaagatggcatccggctttacaaagcagtcataggccaatacatgtactccggcttcttctgcctccaaaagcacctttgcgaactcctcatgtgtctttttattcggttcaaaatgtttcacgtccttcatctggataacaaacataatatacgcctcatagccctcttttatacattggcaaagctcctttatatgcttgattccccgttcagtgggcgcgtccggaaagcgggcgattccgtcttcctccagtgtcacgccttttacttccatgaatattttccgttctccctgttccagatacagatcaaaacgggaatttccgtattttgtctcaggacggatgtaggcgccctctccgaacaggctgcctttacgcagccactcctccaccacccggttgggtatctgggaatccatattgatcagacggtttcccttttttacagcgatcaggtcatacgctgtttttcgttcttttttgtcacttttctccaaaaaaacagaggcgccgggaactaacaattcccggcaccttccagtgttttttacgtgacagatttcttcctgcccgtcaatctccacacgggcaataaaacggttagggcggcttaaaaagcgcccttccctgatattcttatatctcatgcttctgtcagtccctcataaatctcttttacgctgtcaaagacataggttggctttacatctccttcttctatgtcctgtgtagtcgcttcaccggaaagcacacagatggtatccaccccggctttcactccggtcttgatatctgtgtaaagccggtcaccaatgatgacagcatcctctgccttcatgcccagcttctttaatacacagtttaccataatcggctcaggtttaccaataaaaaatggttcttttcctgtggcatttttcagcattatgctcatagagccgcagtcagggatatatccaaagctcaccggacatacaaagtcaggatttgtagccagataaaccacatttctgcccagcataatgcaggtatttctgatcttctctgaagtgttctccgtatcaaatccaatgagaacaacagaggccctgtcatccacctctgtgaccaccgaaatgccggcctcgcgcagctcatttaccagggaacgggttcccatgcagtagactacctgatccggataattttcattgatatacatggctgtggcctggctggatgtatagaaattctcatatccggcccgaatgcccatttttgtcaccttctccacatagtcattcactgactttgaggaattgttggtgataaagatatactgtccgcctcttctctcgatctcatccaaaaaatcaagtgttccctcaaaaatttcatcctcgttgtaaatcgttccgtccatatccagaagatacagcttcttgtctctcagcttctctgcatttttcccgttcttatctgtcagcatttttcttctccttgtaaatcttgttctttttataacgccggaatattctttgtggcgaccatatccacaccggttccgcacacgtttttcagcactacatcaccaatctgtaccggcgctttcactgtcacggattttaaagcctccgcacagtcgtaaatctttccttttggaatatcggaggcggtcttaacagaaaccaccggaagcgtgcccccgctcacccgtacagaggaagtgacgatcctggtggggttggtcacctctttctttccgtaggcttccccttttttacaggtatttccctccacctttttcacggtaccttcttctaatgtcacagtaaggctgcatcccagaggacaattaatgcaaatcaattctcttgtttccatttctatgcctcctccactttcacagtaatcttatcgaaactttcatcatctgtcaaatctgattttttcagaaccacctgttccatctcacccggcgccagctttctcttctttttgtgccagatcctccggtcacccaggtacacgctaacatagcagtccctgtaaacactgcccacccggaaacgcagtgtaatggtatcctccatgcacgcagggcggataacctggggcactgtgtagcgcacgccgtccacagcagagacgggaatcactcttgtatccccctttttctctccccttatataggctgcggcgtaagcaccagcccttgcagcctcctcagacacgtaatccaccagatcatgcacatggagcacattgccgcaggcaaagacacccggcacatttgtttccagactctcattcaccacaggacctgaagtgatgcgggacaattccactccaatttttcctgacagctcgttctccggaatcagtccgcaggacaaaagcagggtgtcacaggaataaaattcctcagttcccggaatcggctttctgttctcatccacctgggccaatgtaatgcctgtcactctttcctttccctgaatgtcaaccaccgtgtgacttagttttaaaggaatgtcaaaatcattgaggcactgtactatatttctctgaaggccgccggaaaatggcatcagctctgccacaacttttacttttgccccctccagagtcatccttctggccatgatcaggccaatatcaccggaacccaggatcaccacttccctgcccggcatgtatccctccatatttaccagacgctgggctgttcccgcagtgtaaatgcctgccgggcggtatcctggaatattcaaagcgcctcttggcctctccctgcagcccatagccaggatcacggcacgggcttccagcatcataaggccgtcctccctgttcatagccatgaccgtcctgcaggtttccccgtcccggatatccagaaccatggtgtgaagcttataggggatctgcagttcctctacctgttcaataaaacgccatgcgtattccggtcctgtcagctcctccttaaaggtgtggaggccaaaaccgttgtggatacactggtttaagattcctcccaattccctgtcacgctctaatatcaggatgttctccaccccttcttttctggcagatactgcggctgcaaggcctgccgggcctccgcctattataatcaaatcataccgcatgatttatcctctctttcccgtttaaaatgtctctgtgatccttgtcagccttctttgatcacgcctgtgagcagctttgagttctttcctgccttagtcagctccaggggatccatgtgcagttcccttgccaggatctccatcgttctaggcgcgcagaaaccggactggcatctgcccattcccgcccttgttctccgcttcacaccgtctaaggatctggcgcccaaaggccgcctgatggcgtttacgatctccccctctgtcacagtctcacagcggcagatcacattgccataagccgggtcttttttgatcagttcctctatttcctccggggatgcctgtgccacattgggaatgtcctccctggtaccgatgaaattctctttcctttctgcgtgcagatactctgccgtcatctgcgccaggtattctccgatggccggagcacttgaaaggccaggggattcaatgcccgccgcattgaaaaagccctctgcgtcctctgcttcgcccagaacaaaatcctcgtttttttccgtggcccgaagtccagcaaaggaggtgatgaccatatgcagaggaacctccgccgcgcttacacgtgccagagaggccacttttccaagtccccgggcagttgtctgaatcccctctttgtcctcaatgtcatcggcagtggggcctacaagaagattgccgtgaaccgttggagtgataagaacaccctttcccatcttggtgggaagctggaatacggtatgagacacaaaatttccggcctttttatccagcagacagtattccccttttctgggggtgatggatattttccgctcgctcaccatattgttgaaaacatccgcatacacccctgctgcattgatcacacacgctgtctcataagattcccggtccgtctcgatctcatatccgcctttttcaagctttctgactgcctttacctctgtatccagaaggaactccacaccgtttacattggcattctccgccagggcgatagtcagcttaaacggacatacgattcctcccgtcggagcgtataaaagggctttgacctcatgggagaggttcggttccagtttatggatctcttctcctctcacgatcctgagtccctccacaccgttttcctccccacgggttttcagtgcttccagcttcggtatatctttctcatcaaaacacagtaccagggaaccgttcctcttatatggaaaatccagctcctttgacagctcttccatcatgcggcttcccttcacattcatccttgccttcatggaacctggctctgcgtcaaaaccggcatgcacaattgcactgtttgctttggaggttccgcagcaaacatcctcctcgcgctcaataacggctgtcttcagatcatatctggacaactctctggccacagcgcttcccacaacacctgcgcctatgatcatcacatcatatttcatctcttcattcctcctgttttctgtaaaaataaaaagagacaacacgaacacacatgcttttacatgtgtcctccgctttgtctctgttctccagcgttatctatttatttttaggtcagcccggtaaatgtgcagaccggctgaaccggtactgctcctacatgaaccagacttcctggttggtggtggatatacacacggctccggcgctgagcgctgccatgatatcctccttgtctgcgatcagccctcctgctatgacaggtgttctgctgtgcgtgcagattctggcaatgatcttcggcatgacccccggaagcacttcgatcatatccgggtgcacactctccgtctgccttctgatgctctcaaaagctatggaatcaatgacaaaaaaacgcatgaccgcaaacagtcccagctcttttgcctgcttgatgatcccgggtttggtggagatcacgccgtccgcctctgtggtgcttttcaaaaaatcaacggcaacctcccggctgctcagccccccaattaggtcaatatgtaccagaacagtcttgcccctctctttcaggcgcctcacaatatcaccgatactgcagatgtccccgtaaagcacaaagacgatcccgatatccgatcccaggcatttcctcagtccctgttcgtccttgatggccgccactacagggcagtcctcaaattgttctaaaatttcctgttgtttcatgagacgctccatttctgtactgtaaactagtaaactatttaatcttaaaaagacaagacaacaaagccgtgatacggctttatcctcttgtctcctgtctcttgttatatcttagcacattcccctgtctcctgcaagccctaatgtaacttgtcggcatctgcctggtaacagttcgttactgttcacatatattattccgcgaggtgctgcctgcgtttgcaaagcaatcccgaggcagccacgcgccagactgtaatttttggtaaccctacctgtagaaacatacaacaggacagcctgcctctatattttcatatatagttgtggctgaagcggtgggaaggttgatacatccgtgagaaccatttgtcttgtagatcgaacctccaaagctgtatctccagttggcatcatgcaggccgattccgccgttaaagggcatccagtatttgacaggctgttcatactcataagtgccgtcctccagtttgcgccctctcagcacctgatttgtctgtttatacataagagaatacacaccgcccggtgtccttctgtctctcatcacgtaagtaccggacacaaaatcagtatccataagcagcgcaccatccttgtaaaaccacagatgctggcttgtcaggtctatttccacataagtttggccgatatcattctccccgtataccacacctgttttagaatatacaggctctcggacagtcactgcatggttggctatgtcctccaaaagctgtgccttttcctttagctgattgatctggaaaccgtaattacctcctgagacagtgatgggttcccctgtggctgtacttgtgatagtcctgtccctgcctactgtgtcataattctcggcaagccaggctacaaactctgtcactcttgcctccagagttgccggatcatcaacataatttccattttcgtcgtatgtcatccattccttcaccgtcataccgtccagaacttctgtcttgtctccgaaggtataggtaactgtcaccgcagcgcaggaattccacacatcccgctgatggatcaatgtggggtcttcttttgtaacagccggggccgcataggcacccgcttcttcggcggagacggattcctggctgcccgccactgctgcctccaaagcagagaacataacgtcctcctgcacggttgtacccgccgtctcatctacaatgacaaactggttttcctgaaatgcaatgtacgcatccgtcggtgcttccatactctcagcctgcatgcagtcaaaagacttaagctgtgcatttaacgcttccctgtcgtactgtatgttctcctccgtctcatggtccgttcccttgaaatatcccttgatccatgtaaatggattctggtcatccaaaagcttctgtacactgccgtcgctgacataggcataacggatatcctgtcccttgatttctcttgtctggtcattcctgaactgcacctggatggaatagtcctccaccttttcccgaatcatgtcttctgcctgctccacggtcatattcccgcaggccatatggttgatagtggttcccttaaaaaatttatctctataatagtaagcacctgcgccgtagccggcagctgccagtataaccacagctcctgtaatgcccagtgcgatcttgattccggtccttttacccttcttttcctcaacccttatttcttttttggccgcttttttctgctttttctcagcttttttatccggttcctgatatgcagccgcttcttcctggctccctatggtatcctggataattttctccatggcagagtcaattttggcctccatctctgatttaggccgtgtctgttctgtctccccttgccggacagcagccttcgccttattctctgcctgctgcgtcttcttttgctgtgtctttttcttcatctaatttgctccccgatattacatttctgtcggaactgcagccgtattcacttgatttctcaggccgcagccgcctatattcgacataaacgcgaatacttgtctattataacacaaaattctacaaccggataaatataaatcaatccttaaaaaaatttaaagcttttgtcatactttcaactccttttagtgtatgtgaaatattttcttcatattctatcctgccgcagaattctgctgggaatgaaccatccatatattagacgccgaaaatcgtcaaaaggtgtcacacagaatagaaattttttttctccgcatactaatcatgcagcgcaggcaactgctgtgactcaacacaagaaaaaaagtgaggaaactgccatgttaaatgaaaaaccttacaaaagcgattatgatgacggaaacattcctgaaatcgacctgcccagggagtcaaacgccactgacgtgatccccgacgaagtgccgcgtaaagacggtcccggcggtgagggctgacaggaagcgaggtgatctctaatgattgacaacgaagaacttcccatcggcttcaccatggaactggcaatgcattcagatgtcctgaatcattttgccaagctttccaagtctgaacagaagcctctggtagataaagccagacaggtaaattcccgtcatgagatgcgggagtatgtggaatccatgttccgcccctgagacgcgctgcttctgaaaccggctgtgacacgcagagaaatctgtactgcacagccggttttttgttcaaaatatcgtttcccctcttttctgaatgtggtatactaaaagtgttttaaaacaaagaaggaggattgctgtaaagcaaaagaaatcatatgtactatttactgaatcaatacttagacacaaaacagatcgtgatgctgggaatcatcattacttttctcatcacattttttgcgctgaagcacccgttttcgtttctgcccagtgaccaggggcgtgattttgccttaaacggcgcgctttcaaaaggcaaaacaagaggtgtcgggctgacctttgtagtctgcttcatcatcggaactctgctctttatgcctcttgacaaggagtatattgtctacgctatactgcttttctgtattatgctgagcgggtacctggacgacgctgccgagacaccgtggaacgaatacaaaaagggactgatcgattttatcatatcagccgtggcagttatcactttcctgaattataacagcactaccatttcccttggctttacagaactggaactcccaaaggcagtctatgctatactgggcattatccttttctgggtctctatcaatgtgaccaactgtaccgatggtgtggacgggctgtgcgccagcctctgcgtgatcgtcatgctgtcctttggcctgatctttaaagagactctgggtacttatgtgatcgccaatttccttttctccgcagtcctgctggcatacctgtattttaattcctctcccagcagtatgctcatgggagatgccggctccagggctttgggcttttatattgcagtgatcgccatcaaatcccagcatcccatcatttacatcctgctggcgggtgtgctgatcattgacggcggactgggtcttgtgaaattattcctgaaaagatttttaaaaatctctattttaaaaaatacaagaactcccatccatgaccatgtgagaaaaaaatgcggctggtcagatacacaggtcgttgcccgttttttgatcatacaagtgatcctggcagtggctgcctacatgctggtaaaataatagtaaaaagagaaacacgcctataaagctgtgtttctctttttttatctcccccgttttgctgttccttaacacgctgttctgtttcatatgagaccaatcacccactcgtcaaatatgaaggataatatcctgaacctcacaatttaagatatcgcacagtgtatcaatggtctttgtggtaatcgcttcgccctttttaatcctgtgcagggtgtttgctgagataccatgatgatggatcaattgatactctgtgaaatttcttctgaacaacgtttcataaaatggtttgtaacttatcatgaacacttctcctattcagtgctgttgtttacagccctgctaaaagcacagctctgtaaatagtaactatacagtgcatttattgaatagtatcatactcaatctcttgactatactcaaaatatcgagtatatttaaaacaaaagaacggaatgggggaatattttatgacaaatcatgaagagccaaagtattcatcagaatacgacaagaaacaattcattgaaaactgtgacaaatacaaggacatcgtcctggaaaacattattaaaaaagcaaaagaaatgggacttttaaaagactagagtctgtccgaagatcacatttggcaggctgtagtcacattttgcggaagatttggctccgatgagggaggcgcagcaagctgcggtgaccgaattggagccaaatacagcaggggatctttttctattcagaatgctgcttgtactctttcctcactttatgtataataaatgggggatttggaaatcctgactgcggctgagaaaaccgcaaataaaaacaaaggaacttttgtatatgaatataagaagactttttgctgtatggagcgccaaattcataaagacagcctgtcagatcacgggcagacagggtgtgacactggccggaaaaatagcgctgtccatctatccgccaatcttaaaagaactggcaggtgaggtcagaaaagacatttttgtggtctgcggcaccaatggcaaaactactaccaacaatctgctggcctctgtactggaggcggacaaatgcagggtcgtatgcaaccgcaccggctccaacatgctgaacggagttgtctctgcctttgtcctgaatgcccgggccaacggacatttagatgcggattatgcctgtattgagattgatgaagcatccactgtccgcgtatttcctcacttcaaacctgactatatggtgctcaccaatctgttccgtgatcagcttgacaggtacggggagatagataccaccatgaatcttctgtcccgtgctatgaaaatggcacctgatatgaagctcttagtcaatgcggatgactccttgtctacctttctggctatggataatgagaatgcatacaccacctacggcatcagtgaacaggtatataaagaacaggactccaaggagatccgcgagggccgtttctgcaaacgctgcggggaaaagatggaatacaagttctatcactacagccagttgggagattattactgtcccaaatgcggattctcccgcccggctcctcagtttgacggcagccatatcgatatgtcggacggcctgtcctttgatgtggatgacttccatataaaagccaattaccgtggtttttataatatctataatatactggccgtctacggagccgcatccctggccggtattcctcttgacagcttcaacaggattctggggaactatacgcctcagtttggaagaaacgaactttttgagatcaacggaaccaggatcatgctcaacctggctaaaaatccggctggttttaaccagaatatcggagcagtcatgacagacaccgccgccaaagatatcataattctgatcaatgacaacagtcaggacggcacagatgtctcctggctttgggatgtggattttgacaggcttagggatgccaatgctgcttccatcactgtcagcggcatccgctgtcaggatatgcgcctccgcctgaaatatgtggatatcccctccactctggagcctgatatcgaaaaagccatccggtccagaatcgagagcggaacaaaaaacctgtatctgctggtaaactacacgggtctttatacaacccataatatcctgaagaaaatggagggcagaaaataatgaaaatcactatcggacatttatatcctgaccttctgaacctatacggagacagaggaaatattcaatgcatgatgaagcgctgtcagtggagaggcattgaagccgagactgtggaattccagcttgaggacaggattgatttttctgccctggacatagttcttctgggcggaggttccgaccgggagcagatgctggtctgtgacaagcttcgcagtatccaaaaagacttcagagattatgtggaggacaacggcgtggtgattgccgtctgcggcggctatcagctcctgggacattattatgacaccgacgacggccgtattgagggactctcccttgtggatctgtatacagagcagggcagtcctcgtctgatcgataacattgtactggaaaaccataaatttgaccttcccattgtgggctttgaaaatcatggcgggcgcacctatatcggagacaatgagcctttcggaaaagtcctctacggcaacggcaataatggagaggacaaggcagagggtgtcctatataaaaatgtagtcggcacctaccttcacggcccccttctccccaaaaatccccatatctgtgatcacttaatcgcaaacgctctggagcgcaaatatgggaaagccgaattgtcacctcttgacgacagccaggaaatcgaggcaaaccagtatatttatcatcgctttgtaacaaaacaatagtaaacagctattgttacgaataaaaggggaaaacttatgggataccgaatcgcgctgctgctgaaacagcactactaccaacattatggtaatcatcttcccgggatctgcgaagatgtctccatcgaatactttacttatgatacttttgaggagcttaaaagtattttcctgaagatcaaaaacgattttgaagggtttcttgtcagcggtattgcccccatgaaagccatatattcccttggtgaacaggcagccggcgctgtcgtagattatttccatatcagcgtggagaacacctattgtcttcttctccaacagatcgtactggatgaacatctgaagctttcccgaatcggaatggattttctccaggacgggcacaccttgaaggagcttctgctcaacaatcagtttgcccagcggatccgtgaatttgaagaggagtggatagacttctcttccaccgtgaacctggatgaaagggaagctgccctctccgtaaaatacagggaactggcaaaacagaacaagctggatatgatcatcacctatttctacagcgttgtggaaaatatgcgggacacttctatcccctgcatttatgtctatcctgatgagaatatgatcagtgatattcttaaaagcatgaaaaaaagcatatccattaaaaatatgaaaagccatctgcctgctgtcatacacattaatatggaaaatatgcctgtacaggatgagatgtcttatgaaaagacgcgcctagagatcaataagatgatcatggaactgaaccagaagtatctgaaccgccttgtcattaagaatacgtatcgggattttgaactgtatggtgattacagcatcataaaagagataaccggagattttcagaagtgccagatcctggatcagcttcacgatctgctctcatttaaaggttctgtgggatatggtattggtcatactttttatcaagccagggtaaatgccattgatgccagccattattccagaaacggcagcttgcaggaggacggcagttacctgatcgatgagaacgaccagctcactgtgctgcagattggcctggtacctgcgggaatgacagtatccggagattatatcagcaacattgcggataaggtaagcctctcctcagagaccattgtgcggatcatccgggtcatgaaacaggaaggcaccaacaagctcacttcccaggaactgatgcatcacctgaacatctccgccagagctgccaacaaatttttagctgcattgcagaaggacggttatgcagagattgtcggcatgaagcgttccggaaataaaggacggcccattaacgtttatcagatcaatctgagatactaaacgctttcttttgtcagaacataattcccttgccagaacacaattctctttgtcagaacagaaaaacagccatttcggttttttctgaaaaggctgtttttctgtttatatatctggtttaatctcatccggaatcgggcattgatagccgtccttcaccgctgcggtaaattccttttttgcatccttgataatctgcggatcctgaaaaacatcgacagccgccattcccatgacctttgctgctgttatcattccttttctgcctatactggagcctgactgactgacctcctgccaggaatgccccggtgttccgaatgccttgcaggccgtcagaatctgtcctgtgggcgcctgataactcacgtcccccacgtctgtacttcccggcataagggttttcaatgggtttatgggtaagaccacatctgccagcactttcccctccattgctgctgctgcattttcaccatgctggctttccaccgctgcggctgcctcccgcatgatctgatccgaaaatgtattctgtatattttttgccagctcatgatcttcactgtcaaaatccggagcaccggcctcctgaaaattcttcatcagaacttctcccaaaaccttattgggaatataatcgctgaatccgtctccacgcactatctcgaaagatgtccctgtcatgatagacgctccacgtgccacttcgctgatcctttcaaatatttcataagactgacaaagccggggcgccctggcttcatagtacacggctgctgtctcctgcacaacatttgcggcatttcctcctgcgttggtgatggcgtaatggatcctcgcctccgggatcacgtgttccctcaggaaattacaccctacattcataagctccactgcgtccagggcacttctgcccagatggggagacgcagaggcatgggacgctttgccgtggaaaatgaaggtggcgcagatatctgccagtgaactggatgaaaaaagcccgttcacatcccaggggtgccagcagaacacggcgtcaagcccttcaaaacagccctcccgtgccataaaggttttgccggagcctttctcttcccccggacatccaaagtagatcaccgttcctgtcccttctctctccttcagataatccttaactgccactgcggctgcaagagaaccggtacccagcagattatggccgcatccgtggccgcagtctgttccttctcttttttcctgtatgtcaatccctggcttctggctaagtcccggaagagcatcgaattcccccaaaaaggcaaccaccggtctcccggcgccaaaggttcccttaaaagctgttggaattcccgccagtcctgtctccacctgaaacccttctgcttccagggtattctgcagcagttttgctgattggtattcgtgaaatcccagttctgcatattcccatattttccggctgatatcagagtaagcttcttccttctcctctatccttttgcataatcttactttttcctctatcattttacatctctccttatatacctaccattactgctcccatgatcagaatgacctccagtgcgatccacattaaaaataatttccagataaatttataccacttattcatgccaatccccatgacaccacacatcatggcacatcctgtaggccagaacattttagaaaatccgtcaccaaactggtaagctataatggcgatttcacggctcagtccgactacatcagcaagaggcgccataatgggcactgtcactacagcctgcccggttcccgaaggaataaagaagttgatcaggttctgtgccagcagcatggcaaatgcggaaagcccggagggaaatccttttacaatattggataaatataaaactgctgtgtcaataatattgccggagctcatcaccacctcaatagaacgtgcaaacccgatcataagaacagtaaataccatggatttggaggattccacaaaagaatctgcaattttactcggccccattttattgataagtcctgttaccaccattccgataaaaaatactgctgcgagctgctgcagataaaacccaaactttgcaacccccactgcgatcgtcatgataataattccaaatcccactaaagtaagtttctgcctgcctgtaaaaggcatctgcataacctcatcacggctggcagtgactgtaggttccggtacaccgtagagataactctttgtggggtctttttttattttttttgcatagtgcattatgtagatcactgttacagccacaaaacagacaaatgccacgattcggaatgtggtaattttccctccaacacttgggatacctgcaatactgctgcccaggccaaccgtaaagggattgaggaccgctgctgcaaagccaacgcctgttcccagaataacgatagaagaccctactatcctgtcatatcccagtgtgatcgcaatggcaacaaacgccgggatcaacccccaggcctcctcattcattccaaacgtagttcccccaagagcaaagagtgtaaaaaatatgggaatcagaaaataatctttgtccttgatctttctcagtatagagcctaccaaagcattcagggttcctgtactcataagcagagtaacgtaaccacaggcaaaaagcaggaaaaatataatatccgctgcatttacaaatccctgaaagatactcatacaaaaagcccaggggcctatgggattggcatccacagtatgataactccctgctaccaccaattctcttcccagtgccggatccaccgcacggtcaaactgccctgccggtaaaacccaggtcaagatggcgctgataagaaccattgtcatcatgatcacataagcatggggcatggaaaatttaaatttccgctcttttttcattgaaaaatcctccttttactttcgtgctgtaaactgttaattatttttagcacgcttatagaactgttcttttatcttaggataccactctgcttaattaaagtcaattggcagtaattgcaaataatatttcatgattttcggaaataatacacaaaaaactccggaatgtaatgagggattatgcagtaaaagccttaatacgtccgtactacaataaaatccattacatttttcaattttaaaggacaaaacttctttaaatgactaaactgcgtactgctgatggctgagatgtgtttttacagggccataaatagcagcgccatggcagaaatatgaccggatatatgatgtaaatatgatataaaatagtggaaattcccagttttaaatgttatactgtttattgaaattattttatgtatgaggaggatcacatcatggcgagaggacgcaaaaaagagacgaggacactggatgaacaactgcaggcagttatcggggaaatcgccacatatgaagagaaattaaaagaattacgccgcagaaaaaaaagaaatcgaacaaaaaatcactgaagacaaaaaagaggctttatatagagcagtaatggaatctggcaaatcactggatgaagttctggctggtttaagcaaccaataaaacataagtcagtcccccggctgttcagatgtgaacaagccgggggactgacttatgtttagataggatcaacgtgactctatttctctctcaaggatcacctgataggcattcgcaccatatacactcattctcggttccaatatctgctttaaacgccagccattggcagcttccgctgtaattgcctccttacaggcttcaaagggaaccggcggcagccccttcttcaccgcccccatcctttccgttttttccggaaccactggtatttcaataaacttatattcatatttcttcataggctgctctcctcttttctcaaaatgtatccaaagtatccattttctatttttatatatcttatattaacctgttcccccacttgatagatatcatctgcgatccagcactgaatcttggcgacatctccctgcagggtcttaaattttacagttatcgcagagggcttcttttcccattggtctccaaattgtgcaaaaaagaactgatcagcaggtgtatcaccaatacgggtgacctcacctactgtatttatcccgtttttatctaaattctttctgagcttttctgctctggttaaaccaaacatatgagagctcctttttatggtaccggtttataagcttaagcatattatacattttttatctgtagcaaacaactaaaaagatagcagatacttgagtgattgtaaccgtcaaataagacagtggcttccatttttataaaaatccatcataattaggtttagaacttttagagtttttggagcagctcctaaaactccaggaaacggaggcctgatcttatgaatgaattatccctaaaaacccagatgagcattcaaaaatggctggatatcatccatcgctgcagagaaagcggactttctaaccgccagtggtgccaagagaatgggatccaactgaaaagctattattactggctttccaaaatccgaaagctggcaattgaacagatcccaagaaaaacatccgctccaccgtcacttccgtccacggtatccagatctgcgtcgataacatttgctgaaatccctgttaagagaaactattctcgcgaggcagatcccatcacgatccatataggaaatgcctccatcgaaatccctacggatgctccggaccctcttatacagtccatcgtccggactgtttcccaatgttaggtgatatttcacgggccgaaaagatctatctggcctgtggatataccgatatgcgcaaggcgatcaatgggttagctgctatcgttcagcagaacttcaaactggatcctttttcaaacagcctgttccttttctgcggacgtaactgcagccgtctgaaagcattgtactgggaaggggatggttttgtcctgctttataaacgccttgagaatggccggttccaatggccccgctcacaggaagaggtgcggcagatctcggatcaggaattgcgctggcttctggaaggactatccatagaccagccaaaagcagtaaagaaactaaaaccaaaaagtgccctgtaggtgtcaatatcgcctgtatttactggagatcctgtcgcttttgtggtataatggaaacatgaaaaagcaaagggtgtaacaggttatgcaggctgaagatcaagttactgtattggaaaaacggatcagatcactggaaaaagaaaaccttctccttcaggaaaaggttgctttcctgactcgtaaactttacggaagatccacagaacagacatcgtctctcggtattgagggacagatgtctctttttgatgaagctgaaacttctgctgacgtatctgctgctgaaccggatctcaaagatgttgcgtcttaccgccgccggaaattcaaaggccagcgggaagattctttaaaagacattccgcacgaaaaaaagctatgcacccttgcagaagaagaccgtttttgtgaaaaatgcggaactcctctgatttctgtcggagaagaattcgtgcgtacagaaattgaattcattccggcaaaagtccgtgtgatcgattattaccgtgaaacttttgaatgcaggaaatgccgaaaagaaggaagagaatatatggaaaaatctccaatgccatatcctgtcatccagcattcctatgcgtccccgtcttcggtcgcctgggtcatccatcagaagtatgatcttgcggtgcctctttaccgccaggaaaaggaatgggcggagctgggagttgctttaagccgggcaaccatgtcgaactggatccttgccagttaccgtgactggctttctccggtagtcggactgctgaaggaaaagctgttggaacagaagtaccttcatatcgatgaaacgcctgtccaggtactcggagagcctggaagaagaaataccacggattcctacatgtgggtgtactgttctataaaaaacagtgggaagccgatccggatatttgattatcagcctggcaggagcgggatatttccccggaagttcctgaacggctataccggatatatccataccgatgcctataagggatatgaaaaggtgacggggattacccggtgcttctgctggacgcatctacgcagatattttgtagatgctcttccaaaagatgccaacagcccgcaggcaacgataccggcccaggcagtccgttatatcaaccgcctgtttgaactggaaaagaagctggaggtattatcaccggaaggaagaaaagcacagcgtctgatacaggaaaaacctgtattggaggctttctggtcatgggcagaaaatgcatctgccgggatcctgccaagatcgaagctgggggaagcctttacctatgcattcaatcaaagatccggcctgatgaattatcttttggacgggaactgctccatttcaaacaatctggcagagaacagcatccgtccattcacgatagggcgcaagaactggctgttttccggaagtcccaaaggagcaaaagccagtgcggggatctacacactgatagaaacagccaaggcaaatggattaaatccacgaaaatatatccagtatatccttggagacatcccgggttctgcgttcctgcagtatcccgaatacttggaagactaccttccatgggatccgatcattcaaaaactatgtcgataaccgttacctttcaagaatagcagaaaggcagcggtttttctatacaccgtcatacttgacggttacgagtgattggctataatgaacggtttcataataaatataaacattaaatgatataagtatattattctttttcctgcgatattgcagcctatatattcaccttttcactttcagctgatggatcacagagatatgcattcagcacagggaattccctgcgcgtttaagcagtatgaggtgtttagaaatggcaggtgggaaactgtaacgaatgggattccaacagatatggatagaattaggtattgaacccttttgtctactatcctatttgttccgatagctttttctcttatacacaaaaaagccctatttataaggctttttaacaggggatgagggattcgaacccccatcgacggttttggagaccggtgctctaccattgaactaatcccctatattctatttactattatacataaaactgattttctttcaagagtttttttcaaaaaaatcaattttctgaaatgtaccttcaaaaccgcatatacaaaacacaaaaaccttttttttaacccgccgtttgcactttcgtgctcaggtcaagccctcgaccgattagtaacagtcagctccatacgttgccgtacttccacctctgccctatctacctcgtcgtcttcaaggggtcttactagattactctatgggaaatcttatctttaggggggcttcacgcttagatgccttcagcgtttatcccttccagacttggctactctgctatgcatttggtaatacaacagatccaccagtggtccgtccatcccggtcctctcgtactaaggacagctcctatcaaatttcctccgcctgcgccggatagggaccgaactgtctcacgacgttctgaacccagctcgcgtaccgctttaatgggcgaacagcccaacccttggaacctgctacagctccaggatgcgatgagccgacatcgaggtgccaaaccactccgtcgatgtgaactcttgggagtgataagcctgttatccccagggtagcttttatccgttgagcgatggcaatcccacgttataccaccggatcactaagtcctactttcgtacctgctccacccgtcggtgtcacagtcaagccttcttctgcctttgcactctgcgaatggtttccaaccattctgagaagacctttgagcgcctccgataccctttcggaggcgaccgccccagtcaaactccccacctgacattgtcccccaaccagatcatggctgttggttagaaatccaatactgcaagggtggtatcccaacagcggctccatggcaactggcgtcaccacttcaaagtctcccacctatcctgtacatgcagtaccgaatcccagtatcaagctggagtaaagctccatggggtctttccgtcctggcgcaggtaaccagcatcttcactggtatttcaatttcaccgggtgtgttgttgagacagtgcccaaatcattacgcctttcgtgcgggtcggaacttacccgacaaggaatttcgctaccttaggaccgttatagttacggccgccgtttactggggcttaaattcaatgcttcgtctcctgacatctcctcttaaccttccagcaccgggcaggcgtcagcccatatacctcacctttcggtttcgcatagacctgtgtttttgctaaacagttgcttgagcctattctctgcggccaggtctccctggcaccccttctcccgaagttacggggtcattttgccgagttccttggcaatgcttcttccgtcggccttaggattctctcctcatccacctgtgtcggtttacggtacgggtacgatatgaacaatagcggcttttcttgacgcatggctcacacacttccctactttagttcggtccgcatcacgtcttcggattgccacacggtttttcctatgtgactcctacctcgcttgccccgggataccattcccgggttgtgctctccacacgtgtccccacagttctgtcatatcgcggtactggaatctcaaccagttatccatcgactacggctctcgccctcgccttaggtcccgacttacccagagcagatcagctttactctggaaaccttagatattcggccggaaggattctcaccttcctctcgctactcattccggcattctctcttctaagcagtccaccactcctttcggtatggcttcatcccgcttacaatgctcctctaccaatgtatttctacattccacagcttcggtgtcgtgttttagccccggacattttcggcgcaggatctctcgactagtgagctattacgcactctttcaatgtatggctgcttctaagccaacgtcctagttgtctttgaaatcccacatccttttccacttaacacgtactttgggaccttagctggtggtctgggctctttccctttcgactgtccaacttatctcgtacagtctgactcccatcaatcatctgactggcattcggagtttgatatgttttggtaagctttgacgccccctagacaattcagtgctctacctccagcagactttgatgaggctagccctaaagctatttcgaggagaaccagctatctccgggttcgattggaatttctccgctatccacacctcatccccacccttttcaacggatgtgggttcggtcctccacttcctcttacggaagcttcaacctggacatggataggtcacccggtttcgggtctgcacatactgactctggccctattcagacttggtttccctacggctccgcgtcttagacgcttaaccttgccagtacgggcaactcgccggaccgttctacaaaaagtacgcagttccccatctaaaggggttccacagcttgtaaacatagggtttcaggttctctttcactcccctcccggggtccttttcacctttccttcacagtactatgcgctatcggtcactaaggagtatttagccttacggggtggtccccgctcattcccacaaggtttctcgtgtctcgtggtactctggatcctgccatgctgtcttggatttcatgtacggggctttcaccctctctggctggctttcccaaaaccattccattatcctcaacagatcaattatgcagtccgaaccccagaatgcacgcattctggtttgggctctttccatttcgctcgccgctactttggaaatcgaggtttctttctcttcctccgggtacttagatgtttcagttccccgggttcccttccatacgttatgaattggcgtatggatacatgaggtttgctcatgtgggtttccccattcagagatctgcggatcaaaggatatttgctcctccccgcagcttatcgcagcttatcacgtctttcatcggctcttagtgccaaggcatccaccctacgctctttcttgcttggccttaccagataccatagcgttggtacctgacggcttgggttgttgcttggtttttgttactttattactcttcgctgtatttctacaacgtctcgttttcgtctctatctttacgtttaacgtattctagatgtttcgtatatgcagttttcaaggtacattgcacaacgaaatcaggaaatgtgttggatgcttgcatccataagcattttttgattttgttgtataacgtgcctgcacgtgactgaggcagctttgctgccgaagtgcaatgtacaagtacgctggctgttttatcagccattcaagcataaaaatcttttatgcttgaatcactggtaaaaccagttatcaagaacagcgcttccccgctggtgtgggttagcatccatcatgatccccagatgcctgttttatttggtaggcctttctcttccccggcctttttaaaagggattccggcagccacctgctttcccaggtcgtctccaaccaagtatcatcggcctcccaggtcttaaccatcgtgttcgggatgggtacgggtgtgtcccctgggcgtatcgccaccggaaatattcggttactaagtaagtgcacaaacggattcatcagtgtgggggaaacttacttccctaagcacttatggatctgtttgtataagcgacgcagtcgcgaccgaagggcttgccctgaggtgcacttgcgcgccttcttggtaactcaacagtgaaacacttttccctacttcttcttccttagaaaggaggtgatccagccgcaccttccgatacggctaccttgttacgacttcaccccagttatcggtcccaccttcggcagctccctcctataaggttgggtcactgacttcgggcgttactgactcccatggtgtgacgggcggtgtgtacaagacccgggaacgtattcaccgtgacattctgattcacgattactagcgattccagcttcatgtagtcgagttgcagactacaatccgaactgagacgttatttctgggatttgcttcgcctcacgacttcgcttccctttgtttacgccattgtagcacgtgtgtagccctggccataaggggcatgatgatttgacgtcgtccccaccttcctccaggttatccctggcagtctctctagagtgcccaccttatatgctggctactaaagataggggttgcgctcgttgcgggacttaacccaacatctcacgacacgagctgacgacaaccatgcaccacctgtctcctctgccccgaagggaagtccctgttacgggacggtcagagggatgtcaagaccaggtaaggttcttcgcgttgcttcgaattaaaccacatgctccaccgcttgtgcgggtccccgtcaattcctttgagtttcattcttgcgaacgtactccccaggtggaatacttactgcgtttgctgcggcaccgaagcctctacggccccgacacctagtattcatcgtttacggcgtggactaccagggtatctaatcctgtttgctccccacgctttcgtgcatcagtgtcagtgacagtccagtaagccgccttcgccactggtgttcctcctaatatctacgcatttcaccgctacactaggaattccgcttacctctcctgcactctagaacaacagtttccaatgcagtccttgggttaagccccagcctttcacatcagacttgctcttccgtctacgcaccctttacacccagtaattccggataacgcttgccccctacgtattaccgcggctgctggcacgtagttagccggggcttcttagtcaggtaccgtcttttttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgtccactctctcaagccggctactgatcgtcgccttggtgggccgttaccccgccaaccagctaatcagacgcgggaccatcctatactgccggagcttttcacaccgaatcatgcgattctgtgcgcttatgcggtattagcagccgtttccagctgttatccccctgtatagggcaggttccccacgcgttactcacccgtccgccactcagtcacaaagacttcaatccaaagaaatccgtcttagtgcttcgttcgacttgcatgtgttaagcacgccgccagcgttcatcctgagccaggatcaaactctctgatcaagtgtttgtccaggaacagaattaactttggctaattctggcttattgagctaggctcaataagatatcccttttactgttttggttcgtttagaaccgttcgttttgttactaatgaatgtaaaagaattttcgattcatgtgtttcactgttcagttatcaaggttcctgtcagtttttgacagctttgatattttatcatatcgttttgtgcttgtcaagaacttttttcaaaaagtttttttgcaatgtgttgaaaagtttttttcaactgcatgtaactttttgttgtttgttgtcatttttgcgacagccatattagattaccatatcttttctgacttgtcaataacttttttaacttttttcataatatctggaagtttcatttccatattataaaaatttgttaccagtcatttccatatcgcatcagctgcaacttgttcactatatcacaggttccgctgattgtcaacaacttttttcataatattctgaattgtgtcaacttctttgaaatattatgatgttttctgtcacttatcggcgacagctagattataatagcacagggaatgactggtgtcaacagcaaatttcattttttgataaattctttctctgtcattttctcacacagaaaacacaggtgatagggccggtgatagacccttatcacaaagatatctgtcaccggcagaatcagagcttatgagccattcatcacatctgtctttttccattatccttgtgattacccgataggtaatctctatatttgttcacttaaggtccagattcccatttttccatatgttttaaagcccgcggatgcatagaaggtctctctccatacatcaaaaggttcaacatacgcacgtgtaacaccattttctttacagctacgcagcgcagccaagagcatggcttttcccaaaccacactttctgtatttttcccgtgtgctgacaggctcgacaaaagctgattttgtgtcactatccacccagaggcaggcgtaagaacataactctccatcaggggcctgcaccataacctcgaattgttcatcaaacataggcgccttggcacgatttttgtttgcctccgtgcaggctgtattttcgattccttcctggtccggattaaatccccaatgagaaacattcgtctttaagacaatatcttttatttctgtcccgtaaacaagtttgaatccttccggcagtgcaggttcaggaagatcttccattgtatgttccattaggtgcacatcacagtctgctctttcaaactgttgtgactgtaaaatatcaatgagttccctctgtgcgtcacagatccaaaatgtatgctctctctttccgttttcatctacacacatattagttttggtccattccaccatctgaggatataaaaactcatacgtctttttaacataaaagaaattttctcccttcctttcaccaacgcagagtccgaccatttcaccgtcctcttcccaaagatggacgcattgatgccatggggcacctcccatacagatatacatggtattcagtctatattccatgtcctcaaagcgctgcgctttccatcccggaaaatgagggtcttccttatactctttgcgcaggaatgagagaactttatcataatcctgttccttttgataatttctgtcaatgattgtcatatcttataaccttcctcatctaaaaaattgtaatccatcggcctaaaatcatcttttttataaatcaatcatactttgcaagtgaaatcataaaagccaggttattgccggatgggaataacaagattcccgcatatcgggaagttatgggaagttattgaaaaaatccgatatacagctatgtcatcatatatatcccataacctctttgatattacccactccgatcaaggcgattttaaaatccccctgcagcccttccagatttgctttcggcataatacaggtggtaaatcccattttttccgcctctttcaccctctgctgtgcctgactgacgccccgcacctcgcccgacaaaccgacctcgccgaaaatcagggtatccgggtccaccgttctgttcctgtagctggatatgatagccgccacgattcccagatcaatagccggctcccccagcttcattccgcccgcaagattgacgtatgcatcacagtttcccagtgccaggcctgcacgtttctccaaaactgccataagtaaattaacccggttatagtcaatacccacagaagttcttctgggcagaccgaaattagtctttgtgaccaaagcctggatctcgatcaatatgggacgtgttccctccagagagcacactaccacagtccctgacgcatctgtaggacggccgttcagcatgacctgggatgggtttttcacctccacaagcccgcactcctgcatctcaaatacgccgatttcattggtggagccaaaacggttcttcacactcctgaggatcctgtaagacgcatgtctatccccctcgaaatacagtaccgtatccaccatatgttccaatacacggggtcccgccacacttccatcctttgtcacatgtcccacaatgaatacagatattcccattccttttgcaatcttcatcaaaatacctgtggattcccggacctgggaaacgctccccggtgctgaggacacttcctcattatacatggtttggatcgaatcaatgatgactgcctccggcttttcattttctattgttgtgctgatggcctccagattcgtctcacagagaaggcgcagattctcattgaatactccgatacgctgtgcccgcatttttatctgttggagggattcttctcctgatatatataagattttatggcctgaatcagaaagcagtttacatacctgcagaagaagcgtggattttccaattccagggtctcctcccaccagtaccatagagccttgcaccacaccgccgcccagtacccggtctaattcgtccatactggtcctgatccggttgtcctcccggatatctatctcagagagcatcataggtttgcctgcacggccgcccgctgcaccgggggcagtctgccctgggccttttttcgtcccctgggaaacagtctcctccacaaatgaattccactcccggcagccgggacactgtcccatccattttgcggattcatatccgcagttctgacagaaaaaaactgtctttttagcctttgccatatgcttgtcctttccgttacaaagataaaacgggccggagcaccacactccgacccgctgcttttaagctaaatcactgtcttatcaggctgtacccatgcttacagcttcttaatatttacagatacctgctcggactgctcaagctcaacgctgaaggacagcttgccgcccagattcgtcttcatctgacctgcattcactccatctatggtaatcgcatactctgtatcttcttccagttcgacggtgatctgagcatcattgggaccttctaccaaaaagctcataccgtcctccatcacatcaagatccagaaccgcagttcccggaacagattcatacacgaacatgccattgcactccagcttggtaatttcattatatgtctttactttatacatgtctccgtcatgctcaaagtcggatagtttggattttgccgccaattcataatttccaaagctgatttttccgttttcctctgttcgtattaactcttttactactgacatctcaatgtcctcccacttatgtctttcaccggggcagaaaatgtctccacgccttccggtgtctttggttatatttttcaatggaaaccttatatgcatgttaccataattcgtaatctttttctagtcattcggctgatttaccacaaattttattccctgtttagaaatgccaagagttacctcatcgccctccttgatctttccttccaggatctcctctgccatggcgtcctcgatcttgttctggatggcacgtttcagcggtcttgcaccatactttggatcaaagccttccttggcaataagctctttcacactgtcgcgtacctttaaggtgatgttcatctgatctttacaacgttttactaaatctttcagcaggattcccacgatcttcttgatctcgtctttattgagggtgtggaagacgatgatctcatcaatacggttcaggaactcaggtttaaacatacgttttacctcttccatgaccccttccttcatcctcttgtaatcctgtttttcatcttccactgctccaaagcccagtttcttcggcgatacgatggcctgggcgcctgcattggaggtcatgatgatgatggtctccttgaagtccacttttcttccctgggcatctgtaatgtgaccgtcatccagcacctgaagcaggatattgaacacatcgggatgcgctttttcaatttcatcgaaaagaataacgctgtatggatttctccgtaccttttcactgaactgaccgccctcttcatatcccacatatccaggcggtgaaccgatcagtttggatacactgtgcttttccatatactcggacatatccacacgtatcatggactgctcgtttccgaacactgcctctgccagtgctttggacagctctgtcttacccacaccggtaggtcccaggagcaggaaagaaccgatcgggcgtttggggtctttgagtcccacgcggcctctcttcaccgcttttgccactgcagttacagcttcgtcctgccccaccacacgcctgtgcagtatctgttccaggcgggcaaggcgctttgattctccctcagccagctttttcaccggtatcttggtccattcagaaaccacctctgctatgtcttctgtctttaccaccagcttcttgctgcggcactgcttttcgtagcgctcacgggccttattcagctctctctcggctttttcctgctctgcctgaagttccttcgccagatcaaaatcctgggcttttacggcctcctccttggctgcatagatacggcggagatgattttctgtctgaacgatcccctccggtgtcttatagccggcaagctgtaccttggacgctgcctcgtcaagtaagtcaatggctttatccggcaggaacctgtcgttgatatagcgaatgctcatggccacagccgcttcaatggctgattcctcaataaccgccccgtgatgcttttcataatagggcgcaaggccttttaatatctccacagcctcctcctttgagggctcctccaccatgacaggttggaatctccgctccagcgcggcatctttttctatatacttcctgtattcctctatggttgtggcaccgataagctgaatttcgcctctggagagggaaggcttcaggatattggatgcatccagggcaccttccgcaccgcctgcccctattatggtatgcagctcatcgataaacagaaggattcctttgttgttcatgacttcctgtacaacttttttgatcctctcctcaaattctcctctgtatttgctgcctgccaccattcctgacagatccagcacaaccactcgtttatccagcatattctccggcacaagcccccacacgatccgctgtgcaagcccctctgtgatcgctgtcttgcccactccgggctcaccgatcaggcagggattgttcttgcttcttctgctcagtatctggatgatccgtgagatctccttttcccggccaatgacagggtccagtttcccctcctgtgccatcttggtaaggtcacggctatactgatccagagtcggcgtctggcttcctgtagatgctttcatcagattcccgctctgcaggtcctccttgggtatcatcttatcctttcccatggctttcagcacgtccaggtaaagctgctgtatattgatccccagggtgtggagtagtctggtccccacacagtcatattccttcagcatagcgatgaggatatgctccgtgccaatgacacctccaccgaggctgcccgcttcctctctggctttatctaaaacccgctgcgctctgggtgtatatccctgggggttctccagcgccacatccccctgaggggcgatcagtttatcgatcagcgccagcagtttcatttcttccacaccgtcttccgccagtaccagccctgctgttcccgccgtctctttcagcagtcccacaagcaggtgttctgtacccacatagttgtggctgcgtccctcggcagttttctcagcggctttcagcgcatttactgcctgctttgaataacgttctttcatgcaagtctccttattatactcatattgcagcgatcctgcgccttcacaaatgccggatcgtcactcatattcttcatagatttcatctatcaattcatgtacctctgccctggaaatattcctgcagcttccttttgccaaaagaaccctgagttcttccttcatctcttccagagcacgtatcttatccgcatctacggagataacagcgcctcttcttctgtcaatggtgacaaaaccctcctgttttaaaacagaataggctttatttaccgtatgcatatttatgcctatggtgtcagccaactgtctcacagaaggaagattttcaccctcctgaagcttggaggtggcaattcccaaaatgatctgattacacagctgaacgtagattgcttcctcactgctgaaatcaatttctatcaacattcttccacctgctttctcttttggaatttgttatatatagaatagcacaaatgaaggttttgttcaagtggatggtcaaaaaaaggaaacgccctgcatctgcagcgtttccttttcattagaataaaagagtcttatttagtaaccgttcagccttccactgtcccgcgaggtgctgccttgcatttgcaaggcaatccccaggagccacacgccagaccgcggtttgtacagactgtgcgcatgcttttgttgctatgaagccgaaaggctgaatagtaaccttatttatgcttcgtcgatggcttttccaatgtcatttcgcatatatttgttatcaaaagaaatccactccactgctttataagcatttgcacgggcctccttcaaatctgcgccctttgccgtcacacccagaacacggcctccgtttgtaacgatctggccgtctttaaatgcggttcccgcatggaatacatagtatccgtctttgtctttgaaggtatctagacctttgatgggaaatcctttttcataggataccggatatccgtcagaagccagaactacacagactgccgcattgtcttcaaactgcagatcgatctcgtccagtctgccgtccacacatgcctcgaatacatccacaatgtcatttttcagtctggggatcacaacctgtgcttccggatcgccgaaacgagcgttgtattccaggaccttcggtcctttctctgtgagcataagtccgaagaagatgattcccttaaactctcttccctcggaagccattgcgtccactgtggcctgatagacatatttttcgcagaactcatccacctctttggtatagaaaggacttggtgaaaaagttcccataccacctgtattcagaccctgatcaccgtcctgtgcgcgtttatggtcctgtgcggaagtcatagtcttgatagtctttccatccacaaaggagagcacggaaacctcacggcctgtcatgaactcctctacaaccagggtattacccgcagagccgaattttttatccagcatgatggttttaacaccctcttctgcctcctccaaggtattgcagatcaagacgccttttccaagcgcaagaccgtcagccttgagcacaatggggaattctgccttttcgcgcagatattttaaagcatcctccgcgttctcaaaattctcatatgccgctgtggggatattgtattttttcatcagatcttttgaaaatgctttggagccttccaaaatagctgcattttttctgggtccgaatacacgcagcccctctttctcaaaaacatctacaactccgcccaccagcgggtcatccattcccacaactgtaaggtcaatggcattctcctttgcaaatgcagccagcttttcaaactccatggccttaatatccacacactgggcatactctgcgattcctgcattgccgggtgcgcagtaaatcttatccacttttggactctgtgccactttccatgcaatggcatgctctcttccgccgcttccgataattaatactttcatattgccccttttccttccgttcactcttttgttttcacaataccgtcttccactgttatcctgtcattcgcgatcagatcgatcgcttttggcatgatgacccactccgcttcctccatgactcttcgctgcaggatctccggggtatcgccctcttctacattcaccgctttctgcaggatgatgggtcctgtatctgtaccctcatctacaaaatgcacggtagctccggtcacttttgctcctcttttcagaacagcctcatggaccttaagcccgtaatacccggtcccgcagaaagcagggatcagtgccggatgaatgttgatgatcttatttggaaaagcttttaccatgatctccgggatcaccacaagacagcctgccagcacgatgaggtccggcttgtaggactgcagggtttcaagaagggcctgattaaaagcttctctgttctcatagcttttcggggatacacagcgggcctcgattccatggtttttagcgcgctccagcgcatacgcaccgggattattgctgataaccacggtaatctccgcattggtgatcgttttattgtcaatggcatccattatggcctgcaggtttgtgccgccgccggataccagaactgccagtctcagcatcgtcttaccagcctttctctacgagatgaaagcccgcagactgcctgtatgggaggaatctgcgggaacttataaactacactaatttaacgtctttttcgccagcttcaatgcggccgatgacatacggtgtctcacctgctgccttcacggcttccatggtcttctccacatctgccgcatccacagccatcaccataccgatacccatgttataggtattgtacatcatcttctcatcaatctcaccttttttagccatcagggtgaagatcgggggaatcggataactatccttttcaatcactgcgcatacgccgtctcccagcattctaggcacattctcatagaatccgccgcctgtaatatggctgcagcccttgacgcggacaccggcttcttttacgcttctgagagcctttacatatatttttgtgggggcgatcaacgcctctcccagggttttgcccagttcgtcatagtaagtctccagagactcttttgtcatgtcaaacacttttctgaccagagaaaaaccattgctgtgcacaccggaggaagccatgcctacaagcacatcgccgtcttttaaatcttttcctgtgatcagatctttttcgtccacgacaccaacagcgaatcccgccaggtcatattcatcttccggataaaaaccgggcatctctgctgtctcaccgccgatgagggctgcatttgactgctcacagcctgctgccacgcctttgacgatctcagcgatcttttccgggtagttcttgccacaggcaatatagtccaggaaaaacagaggttccccgcctgcgcacgcaatatcgttcacacacattgccacacagtcaattcccactgtgtcatgcttgtccatgatgaaagccagtttcagcttggttccaacgccgtctgtccctgataccagagttggcttctccatatttttgaatgcatccatggaaaacgcaccggaaaatccaccgatattggtgagaacttccggtctcatggtctttttaatgtgttccttcatcaattctactgatttgtagcctgcttcaatatctacaccggcattcttgtaatccattttcatcctccaaaggtttgttttctgtattaatattctttatatccaacttcctgcagtcttgcgtcttttgcaacgacctggtttttcagctcttctttgtagtctttcagcttctgcagcagttcctggtcggaagttgctaaaatcttggctgccagaatacccgcattggctcctccgttgatcgcaactgttgcaaccggaattccggacggcatctgaacgatggaatacagggaatctcttcctcctaaagacgtcgtgtgcatgggaataccgataaccggcattgggaaaatcgccgcacacataccgggaaggtgagctgccattcctgcgcctgcgatgataactttgaaatctttctcctctgccgtctttgcgtactcaaagaatacgtccggttctctgtgggctgagatgatcttcatctcatattcgattccaaatttctccagcatatctgctgcctttttcataacaggcatatcagagtcacttcccataacaattccaacttttgccatgactttatctcctttatatttgaattttgttgttaaggctcacgaaactgtgaatcataacgttagcattcatctttacagaacaattttacatagagttctaaatattgtcaacctcatatctcatttttaatggcaggttatagcggaaaatggcagatatccgcataaaaaggaaggccgggtccgcaacggcccggcagtatacgttttataattctcccaatacccggttcagttcctcagtccccggcaggacaaatctgctgtcttctatgattggtatcagactgccatcctttttcacaactgtgatctcccccagctcctcataagggatggtaatgtccgtatgacatccaaaataggctttgcccgcatcgatccttctcagtatagatacttcattgtccctggcaatgatctctttcccgtccggattatataccgcggtatcctcagaccaactgtagcaggtatcacccactgcaaaatgcggtcccatcttctccgcaatgagaatgggcaggatatcctcgatctgatatttctttgccatcacatacgctgttgtgttggtgcctatggcaaattcccccagcggaagcatgtcgtggtggaagagaatattttccttgatatagctcctgttttcctcctcatcaggaaaattcccgcaggtgtaatctgacacctttccatctgtaaatgtcaatttcaaatctttgtaatataatccgtcaaggtacacaccggatacgtggagcacaccgtttgttccgcacagtaccggacttgtaaaaacttcacctacaggaatattgacatccgccacacagttttcaaagttcgtctgtttttcgggacattttagctcatgcagacacactgtcatctctgtgtggttgacacccctgccttttatcttaacttcacagccttcatccagggcattgatgagcttttgctgaatattctgataaaggcggtaatctaaagtgttcagacgcactgtctccctaaatatctccttaaacttctcccctatctcacataccggataggcaataatagtaaaactgcgctcctcacctttgatgtagcggttcacgatctgtccggcctcattgtcataagtcacctgcagcttttgctgatggggtgtcagagaaaaagcttcttttttattctccggtgtaaacggcttctcaccgaatgtctcaataacggccggacctccatgcgtgccggcaagttcctttacctgctcataagccacctgcatgacccgaagcttccgctgcacaaattcctgatccagaaaaagcgctgcatcgtccttatggtcataatcaaactgcttattggggactgccccataatatccgatcctgtgatgctgctttttatttactgcatggacggcactccgatagatgacaggctttaatcccattttctcaaactggaggacagctcttttcacaattggctcaaaccccaattgatagcgaatattcacactgttctttttggtaatatcttttctgccgttaatgaaccctatccggtacccctctgtaaatgtccgggccatatcctgcagttcattttcagcgaagctgttcaggtattccgccatggcaagttcattctctgtcacgtattccccgtacttgtacagatatctcagatctgtcaggtcattgccgcagataatgcgcacagcaaaatcaagagaagggtccacagcttccctgatccttctccctgccatctcctcactgtaatcactcacataccagtagagagtgtcctttatctcctccgccggtacaacaggctcctccagaagattataaatctggacgtacagttccataatcacggtcatatcaaaaaggcggtcctcataggcgtacgccacgataccccgtacctctgcggccaagaaggaaagcagtctcccgtaatcttcccgcagcatacgcactgcatatgcaggattcgcataggatgtctcataggcccccgacagtatcccttcatataaagcctggttgttcttttgaagttccgcaagagacgcctgatccagccatccctcttggatcttctcatggaggttgagcacataattcagaaatggagtcatctccttaaaaaagcccataaacctttccggtacatccatttcctgctgcatgtcccggattctctcttttactagttcaaaacgctcttctaaaaatgtatctttactcatctctaagattcccttttttcacatttttttcaagaataccgtccacatagtccatcagcgtctctgaaccctgcgctgtttttgcatttcttttcataacctgtgatttcttgatctcatgctcccgccaggacttgccgtctgtggcgtcattgagcatcagcggctgaacacagtcaagggaatgggcgaacttagcctccggtgtctcgaatgtttcaaactcctcccacagatccagcattttttcagcctggtcctccggaagaagtccgaatatgcgttttgctgcctttacctcccgctcccgcttatccatatgtccggcctcatcgtaggcgtaggtatccccagcgtcaatttctactatatcatgtatcagtaccataagcatggtcttggccgtgtctatggtttcattggcatgctctgacaaaagggcagccatcagcgccagatgccaggaatgttccgcatcgttttccctgcggatcccgtctgacagatatgtctggcggcggacaaatttactcttatccacttccagcataaattccatttgttttttcagtctctcgtccattttatcctccttatgagatacctaccagaaacagtgcgatccatatgaccatcagcacgccattggccactgagccaaccttgctgtaaagaaattcgcgattctgttcggaaaaacttttcagtcccagtataaacccatagaccgacagaccaagagccaaaatccccaaagctcccaggtacatgccgccctgtccgttcaatgccagggcacagattgctgctcctaaaaacagcaggcaggataccagtgcaagaatagaggactctacgcctcccctggtatgtcttttttttgtaaatgaatatttatagcgtttttttgccatgctgtttcctcctgtattttctatatatataatggctgacggcaaataaaagatatcctattgccgcaccagttgtattcaaaatcatatcatccacatcaaagcatcccagcttagtgacaagctgtatggtttccacgcaaaggctcagtgcaaaaccggaaaaagtaataaaaaagaatccccttgcatttctacaaatgatgggaaggatcaggccaaaaggaacaaaacctattacatttccgaacagattagataccactgccaatactccaagctgttctctgtacatccaaaatcttttgatctcctgcaggggagtcaggttataatgatactctctctgggcaaattccacgccgctgaaccgctccgcaaaaaacaggaaatagacaagcgcaagtatataaaccagaaacaatactgttcccgccgctttaattttcctttttgttttatttttcaatgttctaaactcctattgcatagtctctcctatgtatgaagaagagggctgcataaaacgccctcttccttaattttgtgttattctgtccggctagaatgtgatttcgcttctcttttttaaaagtctggttccgttgataataagcataacgccgctgacaatacttgtcaccattacgatgattcccagtaccaaagcagtgaccccggcacatgacatagtcttataaatcttctcgttcacctagcacacttccttccgtcccgacaaattcagatgattgtctttattcttctgcgccatatttctcataatatgcatcaatggctgctttcatcttatcatcaatgataacttttcctttgtattctctgttgtacagatgctctaccacttcctccatggttacaatggcagttgtggccaggccgtacttttcttctatttctttgagcgcgctcttactgccctgtccccgctccatgcggtctacagaaaccacaagaccgatagggcttacactgccctgcgccttgatgatggggagtgtctcagcaatagaggtacctgctgttgtcacgtcctcaatgatgactaccttgtcgccgtcctcaataggacttcccagaaggattcccttatctccgtgatcctttacttctttcctgttggagcagtaacggatatctttcccgtaaaactcactgatcgccatggttgccgctacggtcaacggtattcctttgtaagccggaccgaacagtacatcaaaatcaaatccgaacttgtctgcaatggctctggcatagtattcccccagcttgcgaagctgtgctcctgttctataaaatccggtgtttacgaaaaatggggtatttcgtccgctttttgtgacgaagtctccgaatttcagcacctggcagtccaccataaattcaataaattcctgtttatacgcttccatcgaatttcctcctactacaatatatttatggttaatacccttacaaccagtaaggaattatccatcttgttgcttaagctgttagaatgagtgtggcaataggtctggccttcacctcctaggacttatcgtccgtagattagtcagccaaccagtccctcattcccagcattcgttttacgcaggttgaaccctccggcgttcgtgtgacatacccagtagattgagtaggcaatgagaaaactggtattgaccattgctaatacatttcaaaggagtatccattatgaacgcagttggtattgatgtttctaaaggtaaaagcacagttactatccgcaggcccggcgatgtaatccttatgccaccctgtgacattcctcacacccagtctggaatcaatgacctgatcgggaagatccgtagtcttgacggtgagaccaaagcctgcatggagcacactggacgatattatgaacctgtcgcctcatggcttgccgatgccggtatttttgtcagcgctgtaaatcccatcctgatccgggactttggtgacgattctctgcgctctcctaaaacagacaaggctgattctaaaaaaattgctcgttatactcttgaccgctgggcaaaattgaagcaatatggtcgcatggataaaacacgtaaccaactcaaaaccatgaacagacagttcggcttttacatgaatcagaagaccgcaatgaaaaacaacctcattgcccttcttgaccagacctatccgggcgcaaatgatttctttgacagtcctgcccgaagcgacggcagccagaaatgggtggatttcgtccatacctactggcacgtggactgtgtccgcggcagatcgctcaacgcctttaccgagcactatcagaattggtgcagacgcaagggatacaatttcagtgcagataaggcagcgaaaatctaccacctctcctctgacctgatcgctgtatttcccaaagataacaataccaggctgctgattcgtcaggctgtcgcaatgctcaacacggcatccgaaaccgtagaatccctacgtcaggaaatggatgcagccgcttccactctgccagagtatcccgtcgttatgtcaatgaacggggtaggcccaacccttggtcctcagctcatggctgagatcggagatgttacccggttcacgcaccgtggggcgcttactgcttttgcaggcgttgaccctggaaaaaatgattcaggacagcatattcaaaaaagtgttcgtacttcaaagaagggatcgccaaacctgcgaaagaccctcttccagataatggatagccttattaagcgttctcctgcggatgatcccgtttacgcctttatggacaagaaacgggcacaagggaaaccttactatgtttacatgaccgccggagcaaacaagtttctccgtatttattacgggagagtcaaagaatatctttccactctgcctgaaaacgaagaaatgtaatctaacttccagcttcataacagaccagcgttttacggtggtcttgtttttgtgcttttctttcaacctgtataaaattttcaaagttcatcaatttctgcttgactttttatttgcagactagttttctattcccgtctattctaccacaccgatcagggattgaatatcctcaattttatttttcttcatataatcctcaatcccctgcacagtctccaccgtggcatatggattggtgaagttggctgtcccgatggacacagccgtggcaccggccaggataaattccagggcatcctccgcattgcagataccgcccataccgataataggcagcttcaccgcacaggccacctggtaaaccatgcggacagctacgggtttcaaacagggacctgacataccgcctgttttatttgccagggcaaacgtcctcttattgatatctatcttcatgcctgtcagagtattaatcagggagagcacatccgcgccgcctgcctcggcagcctttgccatctcggtgatatctgtcacattcggactcagcttcatgatgataggctgctttgcgtacttctttacttccctagtgatggtctccaccgctttcgggtcctgtccgaaggcaatgccgccctccttcacatttgggcaggagatgttgatctccagcatgtctacagcctcacctgccagacgctccactacttcacagtattcctctgtgctcttgccgcatacattaactatgatctttgtgtcatattttttcaggaaaggaatgtctctctcgcaaaaaacatcaataccgggattctgcagtccgatggcattgagcattccgcaggaagtctctgcaatacgtggagtgggatttcccgtccacggcacacttgccacgccttttgtgacaacagcacccaggcggccgagatccacaaactcactgtattctgccccggagccaaaggttccggaggctgtcatgaccggatttttcagttccacacctgccagattaacttttgtattcatcaaagctctacctccgtgctcaaaaatacaggaccgtccttgcagattcgcttattatgcacatgggaatgaccgtccacttcctttgactgacagacacatgcaagacaggcaccgatcccgcatgccatcttctcctcaagagagatgtagcatgtaatattcctctcctcagcataagcctttacagcgcgcagcataggagttgggccgcaggcaaggataacgtccggctccattttattttcacggactgcatccatgacatttccttttatgcctgcgcttccgtcctctgttgtgatgaaaagtctgcctgctgcctccagttcttccttaagaaaaaggtctgcgctgcggtagccggagatgatcgtcacatccgcatccgcctcttttgcagtctgcagcatgggaggtacgccaataccgccacccatcatgagcacacgttttcccctgattgcttccagagggaagccgttgcccagaggtcccaatatatcaaaggtgtcacctgcgccggcttttgaaaattcttctgtcccgctgcccactgttctgtatacgatcctcaggcttcccgcctccctgtctatctcgcacaggctgatggggcggggcagcattctgcttttatcattgctgtagacagagataaactgtcccggttttgcggctgcagcgatctcacgggctgagagccacatactgtacacgccctcagccagcttctcctgttttatcactgtacttcttatctttacttttgccatgatcctctccttattttgcagcctgcagagcgccgtcgatatcagcgatcatatcttccactgcttttcgggaggcgtctgcgaaattcgcctcaccgatctgtgcgtatttctcctgcttgtaggcagctatgataccgcgtgaggaattaacaatggctcccagtccatcctcattgaaaaaatgtaccaggtcttttccctggccgccctgggcaccgtatcccggcaccagaatataggctttcggcataatgcggcgaaggaccctgcccatttccggataagtggcacctaccacggcaccgatgtagctgtaagtgtcacccatgcactcctgtccccattctgccactttctctcccaccagttcgtagagcggtctgccgttcacaagctgatcctggaactcaccgctggagggattggatgtcttcaccagaatgaaaagaccctttttctcttttttgcaaacatcaatgaacggattcacaccgtctgagccaagataggggttcacggtcacaaaatcttcatcaaatccggcgtattcttttgaacccacctggatttttccgatatggccggctgcataagccgcagaggtggaaccgatatcaccgcgcttaatgtcaccgatgacaaccagatctttttctttacagtaatccacagtctttttaaaagccataagacccggaatgccgaactgctcatacatggcgatctggggttttaccgcggggatcaggtcataggttgcatctacgatcgctttgttgtactgccatacagcctccgctgcaccttccagtgtctcgccgcactccttgaaggcagcctcctggatgtgttttggtatataattaagcataggatccagacccaccacgataggtgcgtgggtcttcctgattttctctgtaagtttattgatcatgattcttcctccgtgagataaattattatagaaaaaagaaatttgccgggcattcccggtacctgtgctgttttttattgtttcagcatgccgtcctgtatataggcgatcctgccgtcacagattgtcgcttttaccagcccttttactttgcggccattgaaaggcgtattctttccctttgacaggaaagtcatggaatcaatgacatattccgcttccgggtcgataatggtcacatccgcagcttttccctcttccagggaacctctgtccagaccgatgaccttggcaggattatagctcatcttctctgccatctgcataggggtcagtatccctttgtctaccagctccgtgatggtgagcgcaacagatgtctcaagccctactataccaaacggcgctctggtgataggcatggtcttctcctcacggctgtggggcgcatggtctgtactgatcacatccataatgtcatccttcagaccacggatcagggcatccctgtcctcccttgtccgcagaggcgggttcatcttatagttggcatcattggggtccacatcgtcagaggtcagtgtaaagtgatgagggcacacttctcccgtcactttgatgccctcctcttttgccagctctatcatgcggacactctcttttgtggagcagtggcacagatggagctttgcacctgtctcctttgccagaataatatccctggctgcgatgatatcctccacagcgttgctgatcccaggcagtcccatctttctggagtgctcgtcctcgttgacacatcccttgcccacaatattccggtcctcacagtgggcaaatacaggaacatcgtatttggcagcgatccccattgcgtttttatataatctggcattcatgacggatttgccgtcctcgctgatggcaggcgcaccctgctcgatcatctcctcaatgtcagccagttcttcaccggcctggttttttgtaatggctcccacctgcatcacatggataggtgacaactcttttgctttattctgaacatatttgacacggtccgcgctgtcgatgaccggcttggtgttgggcatggcaaggatcgtggtgaacccgcctctggctgctgccttggagcctgatacaatatcctctttgtaggtcagccccgggtcccgcagatgcacatgcaggtcaataagaccgggcattacatagcagcctgaagcgtcaatgactttatctgtcttatccttgggctttaggcccttgcctgtctttttcacctttccgccctctatatagaggtcacttatctcgtctgtttttgttgccggatcgatgatacgtccgtttctgattaaaatattcatagattcttcctccgggactttacatcttttgattttaatagtaacatacacaatttctttcgtcaattatacattttcacttgactttttttccatttgcgaatatactgaatttgttaaaggaatattggatataaataattgaaagtgcatttaataagcttccggttatcgtgatgttaagcggtttttagagattgtattatttcttatttataataccctctctaaagaccgcttatttttcataaataatgggaactttccacgaagcgtacttactgttttctttatccaatcctaatttttatttttttattttatggaggtaacactatgaacaagggaactgtaaaatggtttaatgcagaaaaaggctacggattcatcacaggtgaagacggacaggatgtattcgtacacttctccgctatcaatggagatggttttaaatccctggaagaaggacaggctgtatcttatgatttaactgaaggcgctcgtggaatgcaggcagctaacgtagaaaaattataatttccggataaactgtacgaaaaacgcggctgggcagaatcttctgcccagccgttttttattccctggcactttttttgttctcatacatcttcttatccgcctgttcgatcagttcctgcagccaatcatggcattccccagacattctgcctgtggctgatcccgcggctatggatattttcacctcgtgctcctgattgtatctttcctgggctttcttcaggttttcctcccatgtacggatactgtgcagacgcttcacaaataccaggaattcatcaccgccgattctgtatatctcaccaaaaccaccaaacgcttccctcagacaacaggcacatcccttgatcatttcatcacccgccctgtgtcccagagtgtcatttattttcttcagtccgttcagatccgccatgaccactgacagctcctgtccctgcaccatggtcctctgcagatcctgcagccgcatctcataggcggaccggtttcccagctttgtcataatatccatataagccagctcttttaagatcctgtcacctgtcttgtcctccagtatctcattcacctgccgcatggtcatgcatataagtgcgcacatgaagcccagaagtcccagttgataatacatggcatatctgctgcccaccccggtataaaaagagaacagggagactgctgccatgagcattaagaaaaatacacccgcaaggaatattttggcatatccggccctgctgctcttcagctccattgccatgtagataacagaacagacaattgcagccgcataaaacacatgggtcaccggcagcatattcataagcttacatacccctgtcaggtagagcagactctgcactagcacattacatgacagtacagccttcatccaatccagcataacggactgtctgttgcagacttctttgataaaggagagcataggaatgggtatcatataaaaagcggaaaaggatatgaaacagatcagcctgggccatggcagccaaaacatcatgaactgggaatccgtaagaatccacaaggcggataccagtataaagatccaggcgtaaaacacactggatacacgaactgcctccctgactctcaaaagcagccacaggagaaaaagtcccgcgctcagcacaagaaggaccacgcagaaaatcagcctgggctgctcctgtacctggacatgcatgaacatactctcctggctgtccagataaatgacctggatctgaaactgtcccgccttatagaaattactgatccggagtgtgagctcttttcccgcatcttctcggttcaattttaccatgcacagagtgtttcccagcatactgcaaaaggctcccgtctcttcctctaaatactggtatctgcgcttaccgtcaatataaacctctgcctgctggtaatggtttaaaaatcccagatatttctcttcctccaaaaattccggaatatcctgccgcagaacaactgcgccgctgctgctttttatcctggaaggcactttgcagatctcttcccctccgccatcggcatcacaataccagccggtatcccatttatataaactgctgtcttttccccagaccttctgaggcttttcctgcagtgctgtaagaaccatcagcacactcatgatcactgccgcaatgatcaaaatccagtgctggattttcctgatccctttttccctcaaccacaattcctccattgaaacttaaaatgtactgctgcattgtttccatcctgcgcagtgtgcccccatctggaggactttcttatgttatgaaaaaaggaaatgcatctctgcatttccaattctgctttcctgtgcttattcagccgcgtctcctgctgtaagctcctggagataatctgtcatggctgtaacattcatttctgtagtggtggcttctccctctgcatcgtcttttgtaacgagactataagcagaatagccgatccatcccacgatcaacagacaaaccacagaaacgattatcttctccattaaaagggaacgtgcctcttttttctggatcttgtcgcggttactcttataatttttatacttgtcaactttttcctgactcatgatgcttctccttatgtatcatatggatattctctggttcttaattataacatatctttttttattttaccactcttttgagatttcttcttccctgatcccatactgttccataaactcccgcagatctgtctggcttttgatcagacagacatcctggaattttcctgtttttaactctttgaaacccgccacctgttcaccggtacagatactggatctgagcacaggcttcatctctgtgcggtcaaaggaaaaaacctcttttttcttttttctaccaaacatggaatcacttccttttcacttataccagccccagggttctcagtaaaaacagccagccggtcaatgtaaatgcggaaaaaaaggttgtcagcataactgtactggaggtcagcacaccttcatgtcccatgttcttcgccatgacaaagcagctcactgttgtggctgaccccagcatgaccagaatggccgtcaggcgttccttcgtatatcccagccggacggccaggggaaggaagatggcagccagtaccaccagctttatcacactggccagcacggaaggccgcagctttgccagcgccttttttccctcaaaggatgcccccatagccataagccccagcggggttgccagaactgccacattcttaactgtcttctgcatgatttccggctgtggtatcctgaaaacagaccataagatccctgccaggatccccagtataatagggttggtaacaattccctttgctgtttttaacaaaagttttctgtcaagcctcttcctacccggcttcataagggagagcaccaccactgctgccgcattgtacaggggaaccgtacccacgatcataagaggggccatgcccgaactgccgtagatattctgtataaaagctatgcccagaatagccgcgctgctcctgtaggaggcctgcacaaattctccgcggatgtcctcctccaccaacaacctggcaagaagggcaatggcggtaatactcaccagtgtggtcagaaagcagaacaggacaaatcccccgtcccagctttcccgcacatccacagaggagatatcctggaacaccagcgccggtatggccgccacaaagacgaaccggttgagctttgccacaaaatcagggcccatcagtcccagatacctgaacagaagtccgagaagcatggtgagaaaaatgggcagagtggcattcaggctgaatatcagattcttcaattatctcagccttccttcaccaggaccttcagaatttctccgatgtacattgtatgataatctttttcagggtaccatttctcatcattttgaggctcgtcaaagttttccgggaaaatgtctccgtgatacagctttttgcagacaaagaccagactggcctcctcaaaagccggagtcccctcgaaaaagcaggtggtaagaccagcctctgcaattttatctctgtcacgtcctgatacactgccgcacaaactcagggcttttctgtactcctccggaaaaaaggagatggtaaatgtgtcatttgcatccacaaattctttggtatagcgctggggacggatataggcggtcaccacatccttcccccagatcacacccacaccgccccagctcgcagtcatggtattgcatttttcctctgtacccgctgtgatcagcatccattcttttcctattttcgtgaatggattgaattgtaattcctctgcttttacttctttgaatgccatagtcgttccttcctttctgctttcctataatctgccgtacaattttgtcatatgccagattttcccttttaatgcatcagaaaatgcatttttgctcattctccacttccaattgtcgcctaatgtagagggtgtattaatcctggcttcactgccaaaccccagataatcctgcaccggtatgatacaggtgtctgccacactgcgcatggccaggctgatcagatcccagtgctgttcctcctttggtgtatggaagctgttcatgtatctgagggctacatccctgtcccagtcagtcaaatgttcataccagcccacagtggtgtcattgtcatgggttcctgtgtataccacacagtttctgtcatacttgtaagtaagataatcactgttctcactggtgtcaaaggcaaactgcaataccttcatgcccgggtacccgctgtcgcgcagaagcttatataccgtctctgtgagaaatcccaaatcttcggcaatgatattccgctctcccagctcttctttcatggtgttgaacagatccataccgggacccttttcccaatggccgttctgtgccgtctcatctccataggggatagaataatactcgtcaaatcctctgaaatggtcgatcctcacaatatcaaagagtttgaagcagtgggcgatcctgcgcatccaccatccgtagtgcattctcttgtgataatcccagcggtacaggggattgccccagagctggccggtggctgaaaacccatccggcggacagcctgccaccgccacaggcaggttattctcatcgagctggaacagctccggattcgcccaggtgtcggcactgtcaaaggccacatagataggaatatctcctacgatctggattcctttttcatgtgcataattcttcacattcttccactgctcaaaaaactcaaactgcagatactggtaaaaaataatgtcctcgcgcagctcatcctgatatctcttcagggcggccggttccctcaggcgcacgtcctcatcccacaagatccagcttttgccgccgaacttatttttcacagccatatagagggcatagtcatccagccagtgattattttccacacagaaggtgagaaaattgccgtcagacaggatcctgctcctctcaaaagccttccgaagaagcgggaaacggctctcatatatcttcccataatcaatataggagggatggtctccccagtcgcaggcatcacactcctcctccgtgagccagccttttccgatcagaaccttcaaatcaatgaaataaggattgcctgcaaaagtggaaaaggactggtagggagaatccccgtagctggtaggacccagcggcagtatctgccagagtctctgacccgtatcttttaaaaggtcaataaactcatatgcctccttagaaaatgctccaatgccgtatggagacggcagactggctattggcagcagcattccacttcttctcatatcactattcctcttccttgccgtttttatagtcaatttttatcagggtaagcccccgcgccggagcggtagggccggctgccttcctgtccctggcagccagtatttcctgcattttttccggcggataagctccgccaccgatctccatcagcgtgcctgcaagaatccgcaccatattgtataaaaatccactgcctgtgacgcgtatggtgatcaggtcattctcacgtgtcactgtaaagcggtgaatggtcctgaccgttgtctttacctgcgctcctgcgccgcagaagcttttaaaatcatgttcgcccagcagatactctcctgcccgcctcattttctctacatccatggggatataggtaaaatgggaataaaaccgctctgtgggcacgggaaatcttctgttcaggatccggtattcataggtcttttcactgacctggtatctgggatgaaaatccccgctgacctccctggacatctggatacggatatcttccggaagacgctggttcagcgcgtacgatatcttttctcccggcatcctggcattggtgtcaaacaccgccacatttcccagggcatgcacgcctgcatctgtcctgcttgcccctatggtctccaccggttccttaagcagctctgacagatggcggttcaaaacctcctgtactgtgattccgtttggctgtacctgccagccgcagtaattggtgccgtcgtaggccacttccatcataacacgtttcataagggacctcctatacaagcacgcggatcacaatatccgctgccagatacaggaagatgcacacataagctgagacatctctgctgtggtatctgagaggcttcatggaagtcctgttctcaccgccgtgatagcagcgtgcctccatagccatcgccagatcatctgctcttctgaacgctgagataaagagggggaccagaagcggcagcaggttctttgccttctggatcagatttccattttcaaaatcagcgcctctggcgatctgcgccttcatgatcttatctgtctcctccatgaggataggtatgaacctgagggcaatagacatcatcatggcaatctcatgaacggggatcctgatcttattcaggggtctcataagcctttccagcccgtctgtaagctggttgggcgttgtggtcagggtcatgaccgaggagccaatcaccagatagatcagccggataccaatttttacagcctgcagaataccttcctgggtgatcttaaagatccagaactgccacagcaccctgcccggtacgagaaacaggttaaatccaaccgtgatcagcagaatgaaaaaaagcggtttcagccctttcaacataaactttacaggaacctttgacatggtgatgatcgctgccagaaatgctgttgccagcagatacccccagaaggaatcagccacaaaaagggaaaccagaaacatgatggttcctacaaactttacacgtgggtccagcctgtggagaagggaatccgcagggtaatattgtccgatcgttatatctcttatcatttgtccaatctctccagtgcctgtattatacttgtcttagcctcctccactgttgtggctgaggtgtccacatgcagcccgcgttccctaagcgcgtgcatgatatatgtgatctgaggcgccgcaagccccatggcctccagctccttatagtgggaaaaaacttctcttggtatgccgtcaaatgccttttcgcctttgttcatcacgatcatgcgctccacatattttgcaatatcctccatactgtgggataccaggatcacggtaattcccctgaggctgtgcagggaggcgatctgatccaggatctcatcccggcccttggggtcaagccccgctgtaggctcatccagaatcagcacttccggctccatggccaggacacctgcaatcgcagcccgccgcttctgcccacctgacagttcaaaaggagagcttttataatatttttcggaaagccccgcctgggtcagcgccctgacagccctctcctgggcttcctctttggaaaagcccagattcttcggcccgaagcagacatcctcaagaacctccgcctcaaaaagctggtgctccggatactggaataccagccccactttgctgcgcagcttctgtctgtcatatttttccgcccatatatcctggccgttatagaaaacagtgcccgatgtgggtttcataagaccattaaaatgctgtatcagtgtggacttcccgctgcctgtatgtccgataatgcccatgaactggccgtcgggtatctctatatccacatcctttaaggcatgcatctcatagacggttcccggactgtatgtgtatgtgatatgctctaattttattgacataatgcgttcaccaattcctctgttgtcagaattcccgcaggtatcttcacccctgcctgtttcagctcataagccagaagtgttacctggggcacatccaggcggtaggattttaattcatccaccctggaaaagacctccctgggggttccctgcatcaccacttttccctggtccatgacaaacaccttatccgcgttcaccacttcttccatataatgggtgatcaggatcaccgtgatgccttccttttcattcagctccttaaccgcacggagtacctcttttctgccgttcggatccagcatggcggtaggctcatccaaaacaatgcatttcggatgcatagccaggacaccggctatggcaaccctctgcttctgtccgcctgacagcttattgggggagtgatgacggcaggcagtcattcccactgtctccaggctttcattcacccgctgccaaatatcctccgtggggattcccatgttctcagggccgaatcccacgtcctcctccactacggtgccgatgatctggttgtcggggttctggaaaaccatgccggccttctgacggatcttccagatttcctcttcctccatggtattcacaccatccagccacagcgcaccctccgtaggaaacaaaagggcattgatatgctttgccagagtggactttcccgagccgttgtgtcccaaaacagcaataaactgtccttctgaaatgtccagctccacgttgtccagcgccctgtatgtaccctccacatggccgctttcatcgtatttataatagtcatgaaccagtttaatggctttaacaattcccattttatatcctttccattgtacctgatttgtaaggatccagtcaaccggataattacagatatctgcctgtcaaatttttcagccacagggccgtttttctattcactgcaggtatatctgtaaacctccatatcctcgcagtcatcctccaggcggtagtcgatcctggaaaatcccagcttacgcgccagctttttggaggccaggttggcactgcgtatcctgcagtacagatacacagcccctctcttctttgcctcctctagaataccgcggcaggcttcataggcgaagcctttacctctgtgtttttcatcgatcagatatcccaattccaccacagagctgttgtggttccaaatcttcggctccacaccggcgcggcccacgatcactccgctctccttctcctccagtacccagtagcccatgtcacacatctcatacatgtatttgcggtatgaagggaatgcctccagctcttcttccaggctctttgccatcccttctgcagtgtcaggcgttccctggcttgtaatttccatcattttagggatatcctgctcagacatttcacggatccgaagtctttctgtctcacacaccactgcggggagatgcctgccgtggcagtataccttctctaaaaagcttccgtcaatctcttcatatccctctatcaccatatccgccgggcttaggtcctgctttcctgagtcgggattaaagtaggcgacacagacgatccccgctgcctttgcagccctgcatccgttgccggagtcctccagtatcaggcactcctcggcagtaagccccatctggcttgccgcttccagaaatacatcaggtgccggtttcggattttttacctgttccccgctcaccaggatgtcaaaatacccgttgatccccaggcttgtcaccacctgccggatataggcaatcggcgaggaggacgcgatggccagacggtacccccggtccttcagccgtttcagaagctcgggtacgccttcgatcatgggaaagccttcctcctcgatgactttctccttgatctgctgcatggactttaccagttccctgtcctccctggaaatcccgtaattatcgtgcaatatatccattaaaaaaccatttgtggaaccgatacatggtttgtaaatttcgtagtccagttcaatcccccgtgccgcaagcgcctgtttccagactctgtaatggaccggctcactattgatgagcacgccatccatgtcgaaaataattccttttaacatactatctcccttttaacggaactttaccctgtgtttttaaagatgtaaaaaaacagggagcgccgctgtcaaagcgacactccctcgtatctctacacggttctacgccggctcaaacagcaaactttccgccagctcccagatttcctctcttccctgctttgtctcagccgagaacgggatcaccgctgtacccgggcgcagtgccagcccttctttcagggcttttacatgcttaggtacctggcttctctttaatttgtccacttttgttgctatgataatcggctcatatccgttgtgcacaatccagtcatacatggttttatcgttagcagatgggtcatggcggatatcgatcagaagaaatactgctctcaattctcctgtattctgcagatatctctcaatgagctttccccactgttcctttactgcctgggccacttttgcatacccgtatcccggcagatccaccagatataacgcatcattcacattataaaaatttatagtctgtgtctttccgggggatgcgctggttcttgccagggatttcctgttcataagcgcattgatcagggaagacttccccacgttggatttccccgcaaatgcaatgtgcggcagctccgttttgggaagcgtgctagtcacaccgcatacaatatccaatgatacatttttaattaccatctttcatcctccgaatatggtttcagacaaaagcctgcgccagcacttcttccatggtactgacaaacgtaatcgtaaggccgtctgtaatctcttgttccatttcctcaatatccggtctgttctccgccggaaccagcacattttcaataccggcactcttggctgccagaagtttttccttcaggcctccgatgggcagaactctgccccgaagggtgatctcgccggtcatggcaagatttgccttcaccggtgttcctgtcactgcggagagcatggccgcagccatggtgattcccgcagaaggaccgtcttttgggacagctccctcaggaatgtggatatgtagatcatgttcctggaaaaattccggtttgatattatatttatccgcaatggaacggatgtagcttatgcctgtctgggctgactctttcatcacgtcccctaactgtcctgtcagcatgaactcgcctttgccgggcatgaggttcacctcgatctgaagagtgtcaccgcccacactggtccatgccagtccgcggacgattccgatctcatccgaattgttcttcctctgataggtgaattttgctctgccaagaaactcttccagattctctgtgctcacagtaacggattcctgcttatcctccaggatccgcctggcggttttccggcatatttcaccgatcttacgctccagctccctgacaccggcttcttttgtataaccggtgatcatctcccgcagggcttcatcctctaagatgagctgtccttctttcagaccatggatcttcatctgctttggaaccaggtgttcacggccaatatgccacttttcattttctgtatagctgctcacctcaatgatctccatacggtccagcaggggcctcggtatggtctgcaggtcattggctgtggcaataaacagtacctctgacagatccagagggatctccacatagtgatccctgaacttgttgttctgctcagaatccagaacctctaaaagtgcagatgaggtgtcgcctttataatcactgctgactttgtcgatctcatccagaagcatcagcgggttcttaacccctgcctgcatcagcccattggcgatcctgcccggcatggcgccgatataagttcttctatgaccgcggatctcagcctcatcccgcacaccgcccagacagatacggacatactccttgtgaagcgcccgcgccacggatttggcaatggatgtcttgcctgttccgggaggccctaccagacagagaatggggctttcaccctttttggtgagtgtgcgcaccgccagaaattccatgatgcgttccttcaccttttcaagtccgtagtggtctgtttccaggactttgttggcctctttcagattcttattatccctggtcatcttatcccagggcagagagagaagtgtctcgatataactgcgcatcacactggactcagcctgactgcccccagtgtttttgaagcgctccacttcttttattatcttctcttttacttcccgggaagccttcagcttttttgcctcctcgcggaactggtccgcctcagagcgggtgtcgtcttcccccagttcttcccggatcactttgagctgttccctgaggatatattccctctggttcttatccacccgttcttttaccttgctctgcagctcggcaccgatctccagaacctctatttcattggtgagtatgatacccagcgcttcatagcgttcttccagtgtcacagcttctaaaaccttctgtctgtcctcatatttcataggcagatgtatggatatctggtcaatgaccttgcccacatcgtcaaactccagaatctgaccagccagttctttgctcatcttgggattcacactgcagtatttgacaaatatctccttaatgccgcggagcatggcttcccccacactctcttccacatgattcagctcctcctcatcaaatgtagccgcctcagcattcagatagtattcgctttccgtaaaacggaggagttctgcccgctccattccctctaccaggacacggactatatttttcggcagtttcacaagctgctttatctccgcaacagttccgattttatataaatcctcctgcgccgggtcctccacggcaggatctttctgggtgatcagaagtacccgctggtcctgcatcatagctttctcaatagcctgtatggacttttccctgctcacgtcaaaatggacgatcatgtcaggaaggatagttgtacctctaagggcgatggctggcagattataaattatgtcactcattcccgcgcctccttaatctctgtgcatatttatgcagtttccggtgtccccctcttacgtccgcctttatttctccttgtaggcggctgcatttccccatgttcaattaaggcctgaccctttccttctaccaactcttttgtgatcttgcaggagcggatggtctcatccgaaggtgccgtgtacataagatccatcatggtattctccataatagcgcgcagtcctctggctcctgtttttctttccatagactttttggcaatggctatcagggcatcatcatcaaagtccaggtccacgccgtcaatctcaaaaagtctcttatattgtctgataagtgaatttctcggctcttttaaaatcttaaccagggcttcctcatccagggcatctaaggataccactacgggaacacggcccacaaactccggtatcataccgaatttaaccagatcctgaggcattacctctttcaggatctctcccacatttctgtcttttctgtctgtcaccacagcattgaatccaatggctttggtatccatcctgttctcgattatcttgttgagtccctcaaaggcaccgccgcagataaagaggatatttgtggtgtcaatctgcaggaattcctgatggggatgctttcttcctccctgagggggaacactggcaacagtaccttccaggattttcagcagtgcctgctgaacaccctcccctgatacatctcttgtgatggatgcattttctgatttccttgtgatcttatcaatctcatcaatgtaaataatgccgtactgtgcacggtcaatatcataatcggcagcctgaatgatcttcagcagtatattctccacatcctcgcccacgtaaccggcttctgtcagagttgtggcatctgcaatcgcaaaaggcacatttaaaagcctggccagggtctgcgccagcaatgtcttgccggaaccggttgggccaagcataaggatattgctcttctgaagttcaatatcggaatcttttccggccataacgcgcttatagtgattgtaaacggctacagacagcactttttttgcctcatcctgtccgatcacatagtcatccagaaatgtcttgatctcctgtggtttcagcagattgatctctccgttgccgtcctccgtataccctgcactgtcctcatctatgatctctgcgcagatttccacacattcatcacagatgtaagtaccgctgggtcctgcaatcagtttccgtacctgttcttctgtctttccgcagaaagagcagcggatcttgggctcgtttccttttatcgccattcttctattcctttcttgttttccgtattaatgccgaaagacccccgcagcaaacaccgcaggagtcttatcattcgttcttacctgtgctcgatcacactgtcaatcagaccataagcctttgcctcttccgcggacatataataatctctttccgtatctctggcaatgacttcaaaaggctgacctgtgttggcggccagagtctcattcagtttcttctttgtcttcaagatcatgtcggcaacaatctgaatttccgtagcctgtccttttgcgccgccagacggctgatggatcatgatctccgcattgggaagcgcaaatctttttccttttgctccgcctgccagcagaaatgcacccatgctcgcagccataccaatgcagatcgtggaaacatcacatttaatgtaatgcatggtatcatagatagcccatcctgctgtcacagaaccgcccggactgttgatatacagatgaatatcctttcccgggtcttctgattccaggaataaaagctgtgccacagtcagactggctgttgtgtcattaacttcctcacccagaaaaataatcctatcctttaacagcctggagtagatatcataactcctctctcctctgctgttctgttcaatgacgtatggtactaaactcatgaaactcctcctattctgtcacacgggcctgagaaacgaaccttttgctcgttactcttctgtcttttccactacttctgtcacttttgcagcgtcagccactaaggtaacagcttcctgaacagcgatatctttcttcatctgctctttctcgtagtcgcccattaattcttttaatttatcggcttccattttgtacatttcagccatttttgcgatttcttcgtctactttttcatcggtaacctggatgttctcaacttcagcaaccttttccagtaccagacggctctggatcctcttcagtgcctgaggtctcatctgctcctggatcttggcattgtcaagaccggtgaactgataatactggtcaatggataatccctgagactgcagtcttcttacgaagtcatccactaactgacgaatctggttctgaaccattgcttccggaatgtccatctgggcattctcaataatagcatccactactttgtcttctttttcacgttttgcaacgtcttctttgcgctctttcagtttctgcgcaatatcttttttgtactcttccagagtgtcaaactcagatacatcttttgcgaattcgtcatccagttcaggaagctcttttactttgatcgctttcacactgcatttgaatacggcagctttgccggccagatcatttgcatggtaatcttccgggaaagtcacattgacttctttttcctcaccgatcacagcgcccactaactgctcttcaaatccggggatgaaagaattggagccgatggtcagaggataatctgtgccttttccgccttcaaatgcctctccgtctacaaatccctcgaagtcaagagtgatcatatcgccgttttccactgctctgtcgtccacgtcgatggttctggagttgttctcctgctcttttttcagctcgcctgcgatttcttcttctgtcacttctgctttggcaacctctacctctacacctttgtattctcccagagtcacttcaggttttacagctacttccgctgtgaagatgaaaggtttgcctttttcaatctgtaccacgtcgatttccggctgggatacaatatccaggccgcactcatctgctgccttgggatactcagactggatcagcgcattggctgcgtcttcatagaagatgcctgctccgtacattttctcgatcatcacacggggagcttttcctttacggaagcccgggatggtgattttatttttgtttttctggtaagcagcctgtactgctttttcaaaatcttcagcggaagcctcaatagtaagcttcgccatgttcttctctaaattttctacctgtacgctcattttaaatgattcctccttgaattctatatgtattcatgcattttgagtattcatgcattcctgcccaaaacggacactttatcatacttacagtcattatcacagtatagcacaaggagtttaaaaataccagcatttttttatgaaacaatggattttttgatctgacgggccttcacctctccctccaactgggaaatcagttccagcgcaaaggaaatggcggttcccacgcctctgctggtggtgatattcccatcctttaccaccgggtctgtaaagacctgggcaccctccagcttctcctcaaatccgggataacaggctgcctttttgttctttaagattccaaggccgcccaggacactgggcgctgcgcagatcgcagccacttttctgtccgatgcggcaaagctctgcaacagctctgcaagcccctgatgctctcccagatgaacggttcccggcatacctccgggcagaaccagcagatccactgtgctgtagtccacatcatcaaaaaatacatctgcttttatctcaatcccatgggaaccggtcacgctcagattgtcggaaatggataccatgagcacctcttccccggctcttctcaaaagatcgaccacagtcagaccttccacttcctcaaaaccatctgcggtaaacacacaaacttttgccatataagtacctccctgtcataaaatcaaacacgtataaaatcctgtatacctgcttattataccataggaatgacggttaattctaaaacttccgtttcttttttataaaatatatgttatacattaatatagaagaaggaggtcatgcagaaatggaaatagaaagaaaatttcttattaaagaactgcccggagatctggataactatccctgccacaggatcgagcaggcttatctgaacacgaacccggttgtccgcatacgaagacaggatgacacatatatcctcacctataaaggggaaggacatatggtgcgggaggagtataatctccccttgaataaagcgtcctattgtcatctgaaagaaaaggcggacggcatcgtcctctcaaaatccagatatctgctgccccttgacggggggcttaccattgaacttgatgtatttcaggctccctatgaggggctttacctggcagaagtggagtttccggatgtggagtcagccaattctttcacaccgccctgctggttcggtgaggaagtcactttttcatccagataccacaacagttccctctcagcaggaacagacaggccgcagtgatgcgggcctgtctgctgtaagatcactcttcaccgaggcttttcatgattttgtgccaggtatcctcccggcgcttctcaatctcctcttccagtgcttcttccccttttcttgttttctccagtctcttagtatatgcccttggaatcttatagagcagctttccccaaaaccgcagaaatgtattaccgctgtccagcagccatacgctgatttcaaaaatatagtccatatgcgacctcttctgtctcggccaagcagcatgcatgcgcttttttgccttttcttatattttaacagcagtttgcatttcttgcaatgagaaatattgctaatccccgtcaagacattgcctattttctacagttccctggtttttttcacacatgcgcggatacagtccgtcacagcgctccgcatgcccttgcgctccaggacaccaaccccttcgatggtggttcctgccggtgagcacaccatatccttgagttcaccaggatgcatgcctgtctcaaggaccattttcgcactgcccagcacagcctgtgccgcaaactcataggctttttttctgggcatcccttcagccacggcaccgtccgccatcgcctcaatgaacatgaaaacaaaagccggagagcttccgctgacagcccccactacatccagcatcggttctgacaccacctctgctcttccgaaggaacggagcagcaccagggcatcctccagctcactttcctccaccagagcatttttgcagactcctgtgatcccttcacctaccagggcaggtgtgttcggcatagtgcggatgatcttcttatcactgcctatgcgttcctccagccagtccatagtcttgcccgctgcaatggagataatcaactggctgctgcaaagcacatcttttatctcagcgatcacctcttccagaaactgcggcttcacagctagaaatacaatatcggatgtttctgctgttttcctgttgtctgtgccgcaggcaatccccagtttttcctttatcttagctgcagattcctctgactttgtggatgctgtgatatcctccctgcctgcaatctctttctccaaaatgccgcctataatggcagaagccatattgccgcatccaataaatccaagtttcatctgttatcctcctcattttaccttttcctgtaactgttcagtccccttatagttaccttttcctactcattatcctctgttgcacctgttttttcaagtgtcgtacatatattttttcaattccccgcatatttttaaacataatgcatgtaaaatccccggaggtctgtctatgcagcaatcatttaaagtctttactgtaatcggcatcctgttcaccatcatacttggttccctgtcccacttcttttatgggtggtccggtaattttttcctggtaggatttttcagtcccgtaaacgagagcgtatgggagcatctgaaactgttgtttttcccggcacttctctttatgctgacagagcagcgcctgctctcttaccgctgtccggacctgctgtgtaaaaacctcataggactatacgcaggactgctgtccatacccgcactcttttatgcatacaccctgttcaccaaaaagagctatctgtgggctgatatccttatctttattctcagcgtttttatcacctacctgctgtcctacaccctgtgcaggaaaaagctcccagctcttttgtgccgcatcagccggacagccctctatattctcttgtccgccttcgcaataatttccatcttctttatgctgtaaaaatgtaactgtccggctgccatttttctgtctcccctgtactttttctcattcttgtattatgatattgttattctgacaaaggagaaaaagatatgagtaatgaaatgttttctgtgtaccactgcaaatcctgcaataagatagaggtgacacaatacatatctccacaacagatggaggaattcggcctaaccgctgaagaacttcttcccatctgtcctgttaccggcagctctgatctggatgaactgggacagatgacagaaaaggaactgcgtcattttgcctacagtgatgtggagggcgtaaaggaatatctgaaaaacagagaaaagaaaactcccagactctgatcttggaggtaccacaaaaagaggggatacccgcgtgaatatcatgcggatgtcccctcttttcatacggttcagcattcacttttcagcttccgggagcctaaaagcttccagactttgttcttcttgaccctatggacgatatgacaggtattcccgcatttcatacactgtccaatatattcatatacaagtacgtcctctcttttcagcctcaggccataggtttcattcagacatgacctgcagtatcccaatccatgtattctttcgtttctcgtcattttcactcctgctccctatattttaataatatcttaatgaatccaatatttcttttcataatatcagatacaatacgatatttcaagacagattacgtattaaaaacgatatttttgaacatagtatcgtgtagaatatcatatataggtggtgaaaatatgcacagcgagaatacttttgaagaaaacaattatgaagatttgttttatgaccgtcttacgcagctcaggtcagcgaagaaggtctcagcaagagacatgagcctttccatcggccagaatccaggttatatcaacggactggaaaataaaaaaggacttccctccatgactgtatttttctatatctgtgattacctgaatgttacaccaaaagaattttttgatgagagtattgtgtgtcctgaacaatttaagaacctttatcaggacatgaaggaactgaaccatgatgaccagcagctcttatgggctttgaccaaacgtctgcaaaaataaaatacaaaatgccgcggactgcagttatatcacaatactgcagcccgcggcattttttacttcttacggcttttttaccgggtgtgctgatcaaagtcctgtttattttccaacatctgtctttcattcttctttctgtactcattgggagacatggatgtcattctgcgaaaagcctgggaaaaataggactgggaagaatatccgaccatacctgatatttttgtgaccggataatttgttgtctctaaaagatgcatagcctctgacagccgtttttgggtgagatagccaatgggggaaatccccttgtaggctttaaacgcatgcaccagatagtatttgttgatatgggccagaagactcaaagactccagggtgatctcctcaaagtaatgctcattgatgtactgttccacaaaacggcactccttggtgacttttttcggcggtgcagccagaatgttctgacgggtatatctggtaatatagaggagcagcagttccaaaagcttctggcagactgccccgctgtccggctcttccagacgcgcctccgaagccatctgtatgaggcagtctgatatcctagattggctctgtcccagaacgtggatactgtaatcataaggtcccttcttctcctgtgaatgaaactgcagtccttcaatgcccagggcaatgtattcccagggacttttcttatttcccagctctgtatgggaaacacccgggtttactaacaccagatctctttcccgcacagggactcttttgttgtctatgataaaacacccctccccctttgtgataaaaaaaagctccgcaaaataatgggaatgctccatgctgtgccagtccttgtcagacctggcgcatgtcacatacaaaagctggacagacagtgacataggaggagggtccatggaatatctctggttgctcatatacagtttctcctgttttctctttgtacctccattataaatttttttccccttgggaacaagcctgtttttaaaacaaatggtaccggaacatctgacaagcctatttcatactgtattatatgtcccaaagcaccaaaaagcctttgggaatattttcttgtaccaaataacaggagggaactatgaaaaagattatatccgttttactcgcagtcacactctgcgcttccatgtgccttacaggctgtcagaagtcagaaaagagtgaaaaagattccaaagattccggaacggaaaaagagctggtggatgtaaaattaaacgaggttgcccactctatcttctacgcgcctcagtatgtggccatcgaggagggctactttacaaaagaggggatccggttagaatgcgtgaccggttttggcgccgacaaaaccatgacggcggtcctctccggggatgcagatatcggttttatgggagcagaggcctccgtatatgcctaccaagaaggagccaatgacgctgttgtcaacttcgcacagcttactcagcgggcaggaaacttcctggtagccagaaaagagatgcctgatttcaaatggagtgatctgaaaggcaaagatattttaggagggcgtgcaggcggtatgccggaaatggtatttgaatatatcctgaagcagaacggacttgacccgcagaaggatatgaacattgaccagagtattgattttggttccactgccgctgctttttccgggggccagggagactttacggtagaattcgagccaagtgccacagcccttgaaaaggaaggcgccggctatgtggtggcctcctgtggtgtagattccggttatgtcccctatacggcttacagtgccaaaaaaagtttcatggaaaaaaatccggagatcgttcaaggatttgtcaatgccctgcaaaagggtatggactatgtgaacagccactccgctgaagaaatcgccaagattataaaacctcaattcaaggaaaacgatctggataccatcaccaccatcgtaaaacgttataaagaccaggacacctggaaggataaccttgtctttgaaaaggagagttttgagcttcttcaggatatcctggacagtgcaggtgaattaaaagcaagagtagactactctaaccttgtggtcacggattacgcagagaacgcaaaaaaataagccgtatcagttcaaaactgatattatgattttcagaagacgtgtttctttaaaaatcctgtaaaataccgtcatctttttttagtcagcctattgcaatatcgtttttaatctgatattataccagtatatcactttttatgtctgatacctgtaaaaagtggtgtaaaatcctttgaacttcttgctgaaaaagcagttgtgttgccggcatcttcactggcgatcaactgttttttcgctttttatgaggttatccctgccagatgtaacgcgaaatgccgtttttctgcgcgaactgctgtgccaaactgccgaaaacctgctaaaattattttatcgctttttattaagattttattaaaacgcagaattaagattacatacttacagaaagttgggatatgaatgactaaaaacgaaaaaatccatgaattggaatattgcagaagttgtttgaacgaagtatatcatctgaatttaaatagaaatgacgtgatggtatatgaatatcttggcacatgcaatcactgccacaaaacctgcaaaatcgtgcacagggtaaagcgaaataaactgtggaaaatcatgctgtcccgaaaattaaaaagcgaataacaatccttttaacttcttgctgtaaaaagcggtgatacagtcagcatcttcactgaccgtaccgccgcttttacgcgttgtttttatctattatttatcagatctcataccatatgatctcattggcctccagatgcagggcaaagctgctcccatcgcctttatacactacggtatcctggggttcatacgtattgttgaccacgcagtattttccgtttttcacatacgcatggacttccacattataattctcggaaaaccacttgtgcaggttctcctcatcgtgggatgaccagaggatcgcccggtagagaagcctgctgttctcaaagctgtagggaagtccgctgatgtatacgctccttccatctccgaaatcattggccgcaagctgcacttccttatctgtctgcttaatgatggtagtttccgggaacgcaaagatactcttctgtccctcgccaaagtctacatcccctctgcagtcctctgtgataaagtgttcatgctcctcccagttgtatttgtccacattcagagtgaatccgttttctttttccactcccatcacaccggagagctggaagtaacggccttctctctggcaggctgtgggttctcccactccgataaatccgccgccttcgtatacgaagcgtttcaccgctatgaggattttctcatccgcccagttctcccctccggaatacgctgtgtaggcaccgcccacgttgagaataacatcaatatctttcaggatgtccggattctctctgatatcatcaaaactgatgaatttcacatcaaagggagcgccgctgagtgcctcgatgataccggcataagaataattctgtttgtagtagatggcatggtgtaccatatgattgccccaggcacgcattttaccccagctattcagcactgccacacgttttacacagtaaggtgtggtcccttttatgttgttgtacagtgtcctgaattcctggcatacactctccacatagtcaataaaatccgggaactgcatggccagcttcagatatccgccgtatccgatacggtcaatgggctttctcaggatagctctcctggctgtcacccagtttacctttgcctccttcaccggatcaccgccttcgtggaaagtatccgggaagaaatagggaagaaaacgtccctctgtatagctgacgccctcaatatcactgatcagacgcagcgtggaaccatttcccacactccccactacagcgtccagtccaatagactgaaactcatccatgaacggttcggttccgatccaatgatcacccaggaacatcatggcttcttttccgcactcatgtgtgatatccaccatctcttttgccagctttgcaacttcccgtctctggaatctctggaaatccttaaactctttagaggggatacggtatgtgttgttcatatatccctggtcaatgatatactccggacggaatttatatcccacctcagcctcaaactgttccagaatatacggacttaccgacgcggaatatccataccagtccacatacttttcccttgccagttcgtcaaagataagagtaaactggtggaaaaatgtggtgtaacggataacatcaatatgaggattatcctgtatatatttacgcagcctctccatggaaaatttatgggtcttgggctgacgcacatcaaaagtgatctgcttttccacgtccttccaatcatttgtcactgcattatacatatgtaccgggtcccacatgatataggcaaggaagctcacggtatagtcatggaaaggtactgtgtcatggatcgtcacatcccctgtctcttcactgtactcccactgtgccggcaaaaccactttcccggatgtacggtcaataacttcccaccagcgggtgatatcatctctggaattcaccttcagcatatccggatacagatgatccatcagatggatactcagctcactgcccggtgcattgcagaaaggtgtcatgatatacatctgctggatctcatccggattggcttttgcccatgcgttgtctttcctggtcgtataataggtagaataaacctttgcatccacatcacgaagctgggcagggtaatctgtgccgtcacagtcacggatggcatctgccccccaccgcttcacaagttccaatgtctccggaactacatccacatctgtgggaattgtaacccgccccttcatttctgctctttcgctcataagaatctcctttcatccggtaaaaatttcaacttttttctttccggcagactgctattgcatccctccggaactctcgaattactatctatagcatacgcaaattttcatcataagtctatcgccttcttgctcacaatattatacatattgcttttttaccatttattcaaacaataaagaggaggtgtttatctcctgtccttacatttttgcagcaaaacaggtgtacagaatcttgataaaattctgtacacctgctgttatttcccactccttcaggcaatgggcttattaatcattttaatcacaaccagtacgatgagcatgagaaggatcgctatgggaagggcgatccaggctgtctgcacaaagcctgcaattatgtaggatataaagcttaccgctgccgctgttatagcatagggaagctgtgtggagacatggttcacatggtcacactgtgctccggccgacgccatgatggtagtgtctgagattggagagcagtggtcaccgcaaacagctcctgccatacaggcggaaatggaaatgatcatgagctggggattggaattcgcaaacactgaaaccacaatagggatcagaataccaaaggttccccatgaagttcctgtggcaaacgccagaccgcatccaactaaaaagatgatagccggaagcaggttcataaatccggacgcccctgactgcaccagatttcccacatactctgccgcacccagactgtctgtcatggccttcaatgtccatgcaaaggtaaggatcagaatagccggaaccattgctttgaatccctccgggatgcatgccatacattccctgaaagagagtacccggcgtgcaatgtataagatcacagtgatcacaagtccgaaaaagctgccaagagccaggcctaccgatgcatcgctctgggaaaaggcctctacaaacccggctccctcgaagaagcctcctgtatagatcatgccgataacacagcagatcacaaggcacaaaatggggatgacaaggtcgatcactttccccttcatgttctctttctccgtctctgcactggcataaggacggcccggtgtggtatacagatccccctgcattgcatttttctcatgcactgccatggaaccgaattccactttcatcagtaccattcccaccatcatgacaattgtgagaagcgcataaaagttatagggaatggctctcacaaaaagagaaaggccatcctctccctccacaaacccgctgactgcggcagcccatgaagagatgggagcaataatgcagaccggagcggctgtggcatcaatgagatatgccagctttgccctggaaatctgctgtttgtccgtaaccggacgcattacacttcccacggtgagacagttaaaataatcatcaataaagatcagcacacccaataagatcgtggctagctgcgcgcccacacggcttttgatatgttcgcctgcccagcggccgaatgcagcggaacctcctgcattattcataagacataccatgattcccaaaatgacaaggaacacaagaatacctacattgtaactgtcggaaagcacgctgataatgcctccctggaaaatctgtgtcacagttccctcaaaggaaaagttggaatagaacacagctcccactaaaataccgataaacagagaactatatacctccttggtgatcagtgccagcgcaattgccacaataggcggcaccaaagcccagaaagtggcatacatgttcggctcatacgcagcctcaccctccccggcaaatacagtgacggcgcacaacagcaccataagtgccgcggccccccacatggcccatcttcttttcctgcttcgcataagaaacttcctctctttctttttccggtttctgttttgtactgcagtgctttttattactctcaaataacaaaaagccatgaacggcaatcccttacgggaacgcgttcatggcagcaaaatttcttttcctgtccaagatgatagcgctccacttccagtgacagtacgacgcatcttatgcggcgtcccagaaacagacacccgggcaggtatccatcccttcggcagtttcccctttctttccggcggccgcccggccctttatgcggaaatactcttgaaacctgcacctctatcattctgccgttcctgacaatccgtcagaaaccttttttatactcttgttatcataacattatcctgtgagaaatccaagtattttttgacatttttctgcctaaaattctttaaaatacaacgaataaagcaacgcgataggtgctgctgtacaaatactacactcttagcctgttgtgaacaacagcataaagtctgaatcatcgtaacagttcagcctgtctgaactgttacgaatcatctcaatttacactctaaatatatagaacattgatcagaaacatgatataataactgtaagaacaatggataactgacacccgacagctgcagattttcctaataggagggatggatatggctaaccgtattataacgatcaaccggatgtacggcagtaatggaagacttatcggaaaagcgctggcagagcggcttgacattccgttttatgacaaagaactcattaccctggcaagtcaggaaaatgatattcccctggaagaactgagaaaagtggatgaaaaacgggcaaaccagtggcatcttcccatcaaagatgccatgcagatggaaccccagtatcactttcagccaatgaatgatgtactttatgaatcccagtcaaagatcatccatgacctgtcagaaaaaggtgactgcattatcgcaggtcgctgcgcagatcagattctggaaggcaaatgtaaaagcatcttcatttttgccccctttgaatacagggtaaagaacatcatggaacggatcggcagggaagagcgcagtgctcgctccctggtgaaaaaaatggataaaagaaggcgctcctactacgaatattttacagatgcaaagtggctggatatgacccactatgacctctgtgtagacagcagcaaattctcccaaaagcatattctggatatgctggaggcggtttacagagatatgtgagtgaagaacgtttaagggacatcgcaggatgtccctttttctatagcctgacagaaacataggttccgtcatgggctgtgacatttataatctcaaggcctttgaactgccgcagtacatgatagctttcccggtatgcttggcgcaggaactttttatctatgtcttttccgtaaggcgccggcagagcgttttgcatttcccggacagcacgctccggaatgcaggctatggccactcccgcaagcctcagaggtatgggaataaaaaggcgtacatccttggagcgaataacaatcctcatcttctctctcccctgatcatcctatgtaaatcttgacaatatcaccattcttagactctacattcacgatatcgcccattgcctctgcgtccagacagtctatcacggtatccagtatttcggtgagatccacgccctgcatattctcactgacaattgggagtttgcctgtgaccttcaggatctggcggatggctgtcaccggaagctgcacattcaccttgtctccttcgctgctgtcaactatgatacgcaccattcttttgtcataatccatattgaccggctctgactttgccacttcataggatgggacttccgcttccttcagcggagccagggctgcgagaagttctgaagcctgctctgccgtaattttgccttcctccagcatttttaatattctcaactgttcttccatgatattctccttttattctgatattttatttcatttgttccagagcttcctccggggtgatttctccccgctccagagcatccagtatttcctttttcttattgccagaaaccggagccggtttgcagcccaatttctcaatcacctcgtccaggcgggaacggacggtgggataagagattttcagttctttttccacttctttaatattgccccggcagcttatgaatgtttcaatgaagaaaagctcctgttcggacaggtaatcaaatttgttcaggtgaaaatcattttcgatgacagtatcgcacttgtcacattttaacttgatcactttaagctgacctccgcagacgggacactgactgatcactttatacatttgttttcctccttatgttttatatcatatacctctcctctatatatgtcaatataaatattcatatttttaattattatattaattattttaatatttatattcattattttaattttatctatcattttctttaaaaatcaccggaatttcgctctcctgcacctcctgcctctcctctgcctcccgcaggcaagccgggtctcagtggaccagctccgcaagctgctccagcacaccccggccgccgccaagagtgatggttcccactttgtcacatattttttccagatactccatttcctttaacttatacagagtctggttttcctccatcagccgtgctgtgttcagcagacttcttgtggaagcaacctcctcccttctcatgatgacattggcctgtgccttcttctctgcagccagaacagaattcataatatcccttatctcccccggaagaataatatccttgatacctgcacttaaaatttccatgcagtaccgattttgctcctcctggagctttctgaagatatattccccaatctcatctttctgggccagcagttcatcaagccggaaccgtcctatgtaatctcttatggtaagctgggcaaaggtgtacagaagctttcccacctcatccgtgataccagccaggcgctccggctctgttatccggtaattgactgtcacattcagacgcacagataccttatccgcagtgagaatctcctgtccgcctatctccaactgctggatctttaaattatataccctgcaggttacctcttttccatagttccagaaaaaatgtgtgccctgatccagccttttttcaaaccggttgtcaaagtaaagcagacctgcctccccctctttgatcactatcctcttataatattttaccggtaataagtctatgtacattctaggtagggtttcctgcatataaggatctgtaatatcgatgatccggaaggtattctcctgaaatacattccagtagtaagtttccggtctgacaaccacatcctgaaacgcctggttcacaaaatgaagggctatactggtgtccggaagctgaaccttcactacacggccggaaaatgcttcctgccgcatcaggatctcacagggaatcccacagttgtccacctctcctgtcataggcaccgtgagtacctcatacccaaggaacctgggatactggtacttacccgctgtgaggagctttataaaccttccgtttttcatcagatatccacattcctgttctctaataatatatttcatctcttctacctcttttcattttttcatttttctaactgttctgtgtcctaataaccgcctgtttttttctgtctctgaaaagaaaatgccccgctttatcctaaggaagcggtccctcccttcagtcttttttcccgtaccggcaggccgcacaagaatcctgcgtctggctgtacgttccgaaaaacggtatccgggaaggctcaggctgcgtttggactgccgcaaacggccaaagccgggacaatttcttttctcttgtcatgaactttcgtttgatcgctataccagcttagctacatgttttaccatggcgggaatcgaacccgcgacaaatcatgtctccttcctttccggcatacctctccgctgctgcggcggcaccgccaaggctcctgttcggaaaaccttgtgcttatggaaaactggaagtttatgtatctgtgatacactgttatcgtactggaaatttacggaagaatcatttaaaaaaagttgcgaagttgattttacaggttgtaaatagtaaaataaatggtaactattcagtaggtctgaacagttacaataaacggtaagaatgccgaactatcacaaaaaatacacccaggaggtgaaccatgtcagaatttcaggagctgatcaagaattttgaaaggatccgggactatatgcgccagtttttcgtatacggctttaaagtccggggagattataaaggaaaaagtgcccgcacctatgacaatgagagaaggcgcatagaaagttttctgaccggttacaccagtgcggaatatacatccaagggcaaaaaggtatacatcaatatggacagcaaaaccataccggaaaatcccctttacgcagcctggaaatccaaaagctttactgacaaggatatcatgctgcactttttcctccctgacctgctaaaagacaacctaaggggacttacaagcagtgaagcggcagaacaaatatcccttatctatcagacagcctttgacagccagactgtccggctgaagctgagagaatacgaaagactgggaattttcacttccgtaaaaaaaggcagagagcttcgctattttttcagactgacgctgcccatggaagacgcttcccacgtaaagctctggaatcatctgatgcaggccgtttccttctatcaaggcgcgtctccctttggcattgtgggaagtacactgcttgacagggaagaaaaacaaaaccggttcttccagtataaacaccagtttcttgtacatacactggaagaccaggttctcatggatattctttctgccatacgtcaaaaaaaagctgtttcctttaaaaacaacagccaccgaagcggactcaccgtcactttacagggtgtccccctgaaaatctttgtcagcacacgcaccggacgccgctatctgtgcctgtatctcacatcaagacagcgctttcaaaatatgcgtcttgacagcctgacagagatcgagcttctggagcctttttccgggtacgaaaaattgcaggaaaagctggagaagcatctgccccactgtttcggtgtctcttttggaggccgcagccgtatggaggagatccatatggaattatacatcaacgaagaaaaagagagctatgtgctggaccgcttgtccagggaaagacgcggcggcagcatccaaaggattgctaaaaacagatatctgtacagcggatatttttatgatacaaatgaaatgctgtcatggatcaagacatttacaggcagagttctccatatccgggggaacatccccgcttccgtccaaaaagtcacaacggactgggaacgcatgtatcagatgtactgcaccggagataatccggacgagcattgacaaaaaacgtttataggagaatcatagtgtgaaagaaagtagaggatagccaaaaagtgacgtactttaataagctaccagaaatggtaacctgtaaaaaagtatagatcagataattagtttaggaagccaggggttccaatggaggtaataacccttcgcgtatcagtaacttctgcgcttgtttgatagccttttgtttttgcttttcaagcaaaacctcaggcatatcaattttgtataaatcactaggattccatgcttcaccagtagacagcatctggaagatagcagtgagaatcatacgagcaatagcaataatggctcttttttttaccccgacgttttacaagagattcatatttctttttgtagtaaggagattggtcggatttcacggccgcatgagcgcattgtactaatgcaggtttgaggtagacaccagcacgagtaatgcgaacagatttcttcttacccccagattcgttgctccccggagttaatccggcccagcagcataaacgctttgaggtacagaactgagtcatatcaataccgatttcggagatgatagtgattgcactgtcatgttttacacccggaatggtacagagtaactgaacagtattttcataatcaggatcagaagaaatcagattttctatcatagagtctatatcagtgatttcggctgtgatataatccatatgtgcgcggacgaggcgcatacggtatttttgggcatcagtcatctgatatccctcgatggattctataacggcatctgttttagatttgagacgtctaagaagttttgatgcgatttcttcgtggttaatagagtgaccggactgttcaagcaggtagtcaataatggatgtggatgacttcccgaagatatcggaaactactgaatctaatgcgacattacagacagtgagcgcattctgatatctgttcttttcactggtacggcaggaaacaagtttgtagcgataccgagtatattcacgtaaaatacggatggtcttacaaggaacataactgcctctcacaagtccaagacggaacaagtcaccaatccatttggaatctttcgtatcatctttattgcctttgacagcttttacccatttagggttagcgatggtgacgtttatttcgtcttctaaaaggttaaagacagggatccaatatttaccggtggattccatacagacatccttgcagttattgtcgagaagccagtgcttgaattcaagaatagaattgttaaaggtggagaaacgcttcttttgatacgaaggttccacaccggaagtggttttaatgattgtggcaacgagaaaagatttgtgaacatcgacaccacaacaggtttgataaacaactttcataagtcagactcctttcgtaaaagaagagaggccattgactgaactgccacacaattaaactaaggcgcttaaacaattcttagtgtgcggactcatagtaccacttatttgtgcttgaaaaggcagaacttacactgattattatgctgtctaaaacgaagaaagttattacaacttctcctcccgtgctttgtagtgtagcttctcacaagctattttacaccaaagagtagaagttggaatactttcattactatttgtgccgccgcttggcggcggaatggagattaaaatgaaagaaactcattttgatatattcgataaggtttacagttgttattacagagtcgtaaagaaaatcttggaggaggcgtccgttcatcctgtcaccagaaaggatatggaggccattgcttccgtatatggatatggtgagagcgctctcaccattgttccgaagcttcttgacagggattgggacctgctgcgcccagaagacggtaaacactttttctcaaaagtaattccctgcaaggttccccttacagatctgcagcgctcctggctgaaagcgcttttggctgaccggcggatacaatgttttctctcaaaagaagagctggaggaggcagcccattccctgaaggatacagaacctcttttcagacaggaggattttcactattttgaccgctgtctggacggggacgactacaattcccctgcataccgaaaacatttccgcacgatccttgaggcgctggaaaatgggcttgttctgcagatatcctatcggggaaagcacggggtttccgcccggtacgaggccgctccctaccagcttcaatactcggaaaaagatgacaaattccgcatctgctgtctgaaaaagaaaggcgggcgttattccctcaatactacattgaatctgaataaaatagatgactgcagactcacttccgaaaaggttcctgatactgccctgcaactgcggttttctcccatacaaaaatccagagaacccgttcttttggaaatcagcaaagaacggaattctctggaacgttgtatgcttcattttgccaattatgaaaagcacacagaatatgatgacaaacgcgacgtctattactgcagcatttattatgacctggccgatgaaacagaacttctcatagatgttttatccttcggacctgtgatccgggtgcttggcccggcttcttttctctcccaggtacggcgaagagtaaagcgccagcatgagatgcttgccaggtgacgtcagatttttcttaccggcagcagttccacataccctctgtttcctaccggttcaagctgtatgcgcggattttccgtatcccagcagcagccaagaatggccggatcgtatttttcgatggcctgctgcacttctatgatagcctggcagtaatcctcctcccggaaaggctctccctgaaacatcagatattttgccgcgggaagatcaatacactcaaatccctccggcagcggctctttaaagtctttggccacctccacaccctgcacatattttgatgtgcccggggtgcggtatgattccggaagccaaagacataccggctcaccgctgatggattttatgctggagaggattccccatacgtcacagcccacttcctggcaatactggaaataatcctccgcttcaatacctcttttcaatatcacttttctggatggtctgtcagtcatctgtacaaatacactttttacagtttccatttcttccggctcctttcgcagacttctatattttacaccataggggataaacagaagcagaggccccggtctgactgcgtactccttgggattacagccgaattcccggaaaaaagcccgctgataaccgtccacactgccaaatcccatgtccagtgccgcatcgattattctgcatttctcatcccgcaggcgaagcgcggacctggacagccgcagacggcggatgtaatctgccggagtaagattggtatactccttaaacagccggtaggaataccacggggagtacagggatacctccgaaagctttgccagcgtgatgttttcattcaaatgctgttcaatgtaatcctgcattctctggacagccagaatctgctctgtcatttctgtcacctcctgtcatctatgatcataccggattttccgctcctgcttctcgacttttcttgccaaccggaaaaacaatgaaaaacagccgcaaagcctgtcaaatctcccgggagatcagacggcttccacggcttttaaccacatctgaatatgactatataatgtaattcagggaacactgtttctgccattccaccagatcggccagtgtgtatttatccaccacgctcttaatggcattgtccagttcctgccagagaacaagggtaggacaggcttctgcacggggacactggttcgtctccccttccaaacattccacaggtgccaggctgccttctgtcaggcgaaggatagaccccaccgtatactcctctggcttcctggacaggcggtagccgccctgaggaccgcggatacttttcacatatccagcgcgggccagaatggagacgatctgctccagatattttgtggagatttcctgccttgacgcaatttcttttactctcaccgggccgccctcatcatgtatggctatgtccagcatcatgcgcagggcatagcgcccttttgttgatattttcatggttacctccagatattccttactttccgaaggcagatactgtcccttatattgtccccgtgtccgtcaggataccgcaccaaatgcctcctccagatcctgaaggatatcatctatattttcagtgcctatggacaggcggaccgtgttgggcctgatcccctgctctgcaagttctgcttcggtgagctgggcatgtgtggtggaagccggatggatgaccagcgacttcacatcagccacatttgcaagcagggagaataattccaaattgtcgataatatccttcgtcttttgggcatcaccctttacctcaaatgtgaatatggaaccgcccccatttgggaaatactttttatacagtctctgctgttcgggatctgtgctgacagatgggtgatgaacctcctccaccagcggatgcttctgtaaatattctaccactttcagcgcattctgtacatggcgttctacccgcagggaaagagtttccaacccctgcagaaacaaaaatgcatggaagggtgacagggttgctcctgtatcacgcagtaaaatggctctgatcttcgtcacaaacgctgccggaccaactgcttttgtgaagctgacgccgtgatagctggggtttggctctgtgagggaagaaaacttaccggatgcctcccagtcgaatttaccgctgtccacgatcacgccgcccaaggctgtgccatggcctccgatgaattttgtggcggaatgtaccacaatatcagcgccaaattcgattggccgcaccagaaaaggtgttgcaaatgtattgtcaactacaagaggaatgttatgggcatgggcaatctgtgcaatggcctcaatatccactacctctgaacggggatttccgagagtttcgataaaaacagcttttgtattctcctgaatggcactctccacttcttctttattgaagatatccacaaatgtggtttcaattccgtaatccggcagtgtgtgctccagcagattataggaacctccataaatattttttgcggaaacaatatggtctccctgtttggccagattctggaatgtgtaggatatggccgctgctcccgatgccacagccagtgccgccacacctccctccagcgctgcaatcctctgttcaaaaatatcctgagtaggattcgtcagcctgccgtaaatatttcctgcgtttgacaggtcaaaacgtgcagccgcatgtgcgcagtcatcaaatacataggaggaagaggcatagataggcactgcccttgcgcctgtcgccggatccggagcctcctggcccacatgaagctgtaaagtctcgaatttgaagttcctgtcttttctctctgtttttttcatagttgtcaccctcaccttttctgatattttcgcagctatttcgtcatctgaatggctgcatatttgcttatattttcttatgttttcaagtatctgcgcatatatgttactaattctggaataattgtgtggagtaatatcggtccccgctgtccggcagaagcactacgatattctttcccgcatattcttctctcttagccagttccatagccgcgaagacagccgcaccggatgaaattcccaccagtatcccctctttttttgcaatcttctttgcggtttcaattgccgcgtcattatccacccggatgatctcatcatatatctccgtattcagtacagcggggatgaatcctgcgcctatgccctgaatcttatggggtcccggcctgcctcctgagaggactgccgaatctgtgggttccactgccaccaccttgatatttggattttgtgattttaaatactctcctgttcctgtgatggttccgcctgttcccacacctgccacaaagacgtctacactgccctgtgtgtcattccagatttccggtcctgtagtctttctgtgcatttcgggattggacacattgtcaaactgtcccggaataaagctgccggggatttttttgctgagctcttccgcttttgcgatggctccgttcatccctttacttccttctgtcagcaccagctccgcgccatatgccttcagtatattcctgcgctccacactcatggtctccggcattgtgagtatcaggcggtatcccctggctgctgccatagaggcaagacctattccggtattgccggaggttggttctatgagtaccgtacccggcccgatcagcccctgcttctcagcagtgtccagcatattctttgctattctgtctttcacactgcctgcgggatttaaatattccagctttgccaaaatcgccgcacccagtccctcctctttttccatattctgcatttccatcagaggggtacttcctaccagctctgctgcacttttatagatatgatctctgttcattattttctcctttcatatatttcctatcgacttaataggaattataactgcattcgtttctcctgtcaagaaaaaaattccatattccccgatttttttcggatgcaatatggaatcttgtttctttccggttaaaccgatccggtatctctgtctggtgcttccccgcccggcatctctccaaccggtgctttcattccttccggcatttctccgtccggcatctctccgtccggcggctccattccttccggcggttctgtatcatcatcggcagttccggatttccggctgcctggtccatttcctttcataccgcctcccatttctcccatggctcccacagaaccgttggaagtgacaacagattccagagtaagctcgtcactctcattccccgcagtgagggtatatgtctccccttctttcattttggggcagcttatcagcacagaagaatattttttctcaggcgtccagcttaacagctcatttccatctgcatcttttagtgtgacagcagactgtgcctcctgggtttccgtgagattctgcagaatggagcactgcgtggaggattcgctgaatccctgtaccataccggaacttcccactgcgatgatggtgccgcctgttatatctgctcctccgttataatcaagggcaccgtccccatcagacaccggcccgttcacatagacggttccccctgacataaacaggcttccattagaatcgagaccgtcaccctctgcgtctgctcttaaggtcccccctgttattttgatgtagagttccgtatcattccccatactgctgtcaccttttccaccggggacatccgcctcctcctcttctgtctttgctcttgccgcattaaccgcatcatcactggccgtcaggctgatttcaccgccatttaccacaactctgcacccttccagtccttcatagcaggaattcacattgatcataccatcatttacaaccacatccaaatccgcatgaaaagcgtcatcacctgactccactgtaaaatcaccgccatccagaacaatacttccgcttgtgtggagcgcgtcatcctcagtcttgataacaaaagtgcctcccgctatataaatatttcccttcacagactcatccgcattctcggacttcattcccttgccctgagctgagagattgaaagtgccatccagaatctttatgcagtccttgcctgtcagacaatgtttttctgcgctcactgtgatctcaccgccagtaatggccagatcattttttgatacgatgccatgctcatatgcggctgtcacctccaaagctccgctcccattcactgtaaggtcatcctttgaaaataccacaccatctacagtattatcatccgtctgtgtatatgtactgcctccgctcagactgttccgactgttttcagccagggtgagaaacactttgtctgcattttttacatataccgcagcactcgtctcacagtggatctttgcattgtcaaaaacaatctgcactttatcactgtcccctgcatcaaccacgatctgcccatcgctgagcgtgcctgtaacataataaacgccctcaccggtaatggtaagcgtgctgccggaaacttctgcactgccgccttccgcctgaatagaatctccgtcaagagttatcaccaccgcctcgtctgtatcatatgccccctctttatcccggtctgtaaattccgaatctatctcagattccgtcagttccagattctggtccacgccttctgtactgccggttccttccatcataccgcctctgcccctgctgccggaatccgtcccggacgctgcctcacttgttttctggctgtctgtctgttcgcttccgcatccttccagtgtgcctgccaagagcaggaccaccagaagcacagccgctattttcctattatacatatcttttacagctcctctcttatagccgcagcactgctgctgagtatctccagattgccgttccggcagcgcaggtcatctatcatcttcttctcatctttccggtcttttaacacaacccggtattccagacggaacagactgcccatattggtggttttcacctggatcagttcccatcttttcagatattgttcaaatatttcgtcaaacacctctgtatagtccagagactccggaatggtaatgcgcagcgaccgttcctctgtgcgcttctccccaaaactgctgactgtgaatatggtatttgccgcaccgatcaccaccacaaaaagcactgcaatgccgatatatcccatacctgcggcaagtcccactgccatagccaggaaaatactgctgatctcctttgccgttcccggcactgagcggaacctgaccagtgaaaatgcccccatcaccgcaacacctgtacccagattcccgttgaccagcatgatgaccatctgcacgatcgccggcatcagcgccagcgtcacaacaaatcccttggtataggtattgcggtacatgaaaatcactgcgatcacaattcccagcaccaaagatgccgccgtgcaagccagaaaagcagccggagaaaatgtggctgtggtctcatttacaaggattgactgaaagcaaagatcaagcataatatctccctcccttctcttccctgtccggtatacactgcagctgtctcgtttctgcctttttactgtcctctttccccttctcctcactctgcatccggtaagctctgccgtattttgaaaaggatattggatagatgtgaagctgatccagaatccctgagagccatacaggcatggcaccggggattttgatctccatgagctgctgcccctcctccaggatctgctgcccccaggtttccttttttagatccagttcctgatccctgaaccggatattccagtcaaatgtcaccctcagctccggttcctgaatgtcataggcagcgatcctgtcataggctatgtacatggccggtgctatatttttataaaattgcaaaaaccagtcaatttcccgcaggatttgggtatcgacccctggtttttcatggcgtataaggtatccctcagcctcggacaataccatattctcccggcgcttgtaaacgatcccttgatattttttcttcagctccaaaaatacaggcccgtcctttaccaccttcccatagctgcgcagccgcagcttttccttatagaccggcttgtctaaagatgcgcggataagctgagcatccggcgtatcaaaatagatattgcatatggtggttgtcccgtaatcgtccggcacaagccttccccctgtcttttttataaattcattatattggctgtcgtccagcaggtatttcttctcataacgctcaaatgtcatctgataactgcccatcatgttcctccttggtttttttattactcccccagtatagcgcctcaaccttaaagcaacttaaaaagacagacagcaattttttctgctgtctgccataagtaaaaaatgcactccgcgtttacggagcatctgttattttaatgatatattcttttttgttatattcttttttttcgtttatggggatccttgccgtaaaacaaatctttttgtctattgccctggccgtgatcttccctctatgtgcctttacaaccgcttgagccacggataatccgatcccatacccaccagtgtccctggagcgggagctgtctgccctgtaaaaccggtcaaaaagtctgttcagatctccgtcaggaatctcctcacagtcattgcagacggaaagttccagatatcgttccttcctctccagggatacctgaacacctcctccctccggggcgtatttgaccgcgttgtccataagaatggtgacaagctggcggatattggattcacacccgttcatatggatccccgccggtatctgtttctgaacctgtatatttttcgcctgcgccatgggagcaaaggcctccaccgactcctttactgtctctgagcaggaaaagtaggcagtctgaagatgttcctgcatttcttccagcctggacaatgtgagcagatttttcaccagttctcccaggcgctctgcctgattccgtatactcctggtccactcgctctctccctggcacatttcaatcacctctgtgtcagcggaaatgatggcgataggggttttgatctcgtgccctgcgtctgtaatgaactgtctctgcttctccatactttctatcacaggcctgatggcccgtcgggagagcacactcacgaaaaacagcaccaataccaggcagagtaaagctacgatcatggatatcagggcaaaattgcggatagactgcaagtcattgccgcagtccacaaataccaatagtgtctgcccgtcctctttgactgtcatctgatatttgtactgtccgcagtatcctttctccctgcccttttccagcacttcattggcaaaggctgctgcctcctcctctgtgactgcagccacatgggttagatcgatctgcatctgtgaggcctctgcctccccggactcagccagtgctttcggtatcacggcagaaaaatatctcgtctcaaaaggtgtctcttctgacatccggtagccaaataatccgccccttccacgtatcccattgctttcctggcccgtgggcggctcatccggatctttcccttccgtgccctggctgtccccattcttcggcattgtattctctgcaagtccgggcggatggtttcccttgtccccctgttttgggaaacttccctcattttcaatcaacatttccagaagaatatcggattttccggttatctgataaatattcagaccgttgatcccacccaccaccaacagcagaacagccagcagggaaaccatagttatcacaacaaactttctctgtagtttttttatcatatgcgcacctttccgctcaggcttttttctccagcttataaccaattcccctggccgccttgatctcaacaggtgcctccagattctgcagcttttttctcaggtaagagagatagacccacaccacgctcacttctgcttctgcatcaaatccccaaatcttctccatgaactgttctgctgacaggaactgattggaatttctcatgagcatttccatcatctggaactccttgttccccaggcggagcgactgacttttataggccagctcgaaattctccctgtttaaggtcagtccttcaaaatccagcacatttgccgagaactctgactttcttctggtcatggccctgatcctggcaagcagttccttcatggcaaatggtttcggaagataatcatccgcccccatgtcaaggcctgtgacccggtcttcgatttccccttttgcagtgagaagcaggatgggtaccgtgcatccctgttttctaagcgcttccaatacttcaagtccgctcatcttcggcatcataatatccaggataatgccgtcatactcagccgcctgggcccagtcataggcatccgccccgttgtaaaccacatctatagaataattgttgtgcttcagcaccgctgccagcgcgtttgccagttccttttcgtcttctgcgagcagtaaacgcatgtttttccctccggtctgtgtaataagatagtttcttatcatttatcttaacataaaaaccttaaaagaagctaaaaaattcccgggccgcagataatcttctgcagaccccgggaaaagaacacggcatatctcacgctattctcttatctttatccaataggctccttctcatcaccgtcactgtaaatatgtacggcgtaattcacaccatcctccacgtaatactctacttctacactgagtccggattttatgatgacaggacagtccacaatggccatgcctatatcataattgaccgctctgtcttcgccctcacccccgtaggtccttccgcctatattctcttcatcaatgctcatagtattgccactcacgttcagcacatatccggcagtctcgtaggtctctctgccgcctgaaggatcataatgcccttcttcgtctgtgtacgcatcctggttctcgccgccttcgccggcattcacctggctgtcagccccattactctcttctggctcctcctggttttcagccttatcctgaccgctattttcctctttaccggaagcttcccggctgacggaatcgtcactgccctctgatgtatttgtgtcttctgtctttttatttggttttataacctttgtctcttcctcctttttgtccttgtcattttttactgccttatccttcttatctgtgtcttccgtctttgttttcgtgtccttgtcttcattgctgctgcatcctgccagaaggcttgccgataagatcaccgctgcagccatagccgctaattttcctgctctcataattttttctcctcgcttatttttttaggggtgggtttcatacatccaattccggctgaaaattgttttctccggaatcggatgatatcctgcatggaatctgctccggttcccaggcctttgcaagctttccatccaaaaacccaaatgtctggcggtatatcacgccgtcccaaacctcagggttcttctctgccccattacaaaatactcccaggctgtatatgatataactcccctcatatctctctacctgctgtacatgggatgggtgataccccagcaccagatctgcccccgcttcaacggctctgtgtgcccactcctcctggcttttgccgggcttttcggccccttctttgccccagttcatacacactacgatcatgtgtgcgcctgcgccctcagccagctgtatatttttgatcagcagtgcctgcatatccatggatctgtcaagcacatcaatgccgatgaagccaatttgaatcccatttatatttttaaaagagacacggtcatttccgaatgcagcaactcccgcttcgttcaatgcgatggctgtatcatagtatccgtcctgtccgtagtcctttgttctgtcatttgccaggttcaccaggtcgatggaaccctctttgaaaatttccgcgtattctttctgtccctttatgggatgtttcctggccgctgcagtctcatctgacatgtcaccgataaaattcgcaacatttatatcagctttctccagttctttctttacattccgaaaaaaatatccagggtcttctgccctttcgtatgcctccaaaaagcttcccttttctcccgttccccgctcatcaccaaaaatgcaggtcccgacagctcctatggtcaccttcgtcatcttcgcctccagctcaatctcccgggctgcctgtgcttttgattccctctttgcagatactttaggcacaaacaccaggaagaccaggagcagggctgccatcacaagaacacctgataaaagtgtttttttgacacgcctgacctggcggacacgtcttattttgttccttctgatctttttatccatatttacccctcttttacagcaaatgattggatttgctgtccatgcttggtattatatagaaaagatgttaccaatataagccatcttcttttaagtttgaacgactttaattgaacaaaccaatgactatttttttaatgaactgacaaagtttgtgactatttttgcatttctatgtaccataaaaaataaattcttaacatgtcataagtcaaatatgtcactattctgctttttttccgctgtttaagccccattacagatgtaatctatgacaaagcatgtcacatgtgtgtaacattctgttataccatggatttcacccctatattatcagataataagacgttttaatagacaactacgtcaacgtggccgatacatgctcaaacgttttctggattctcaaaattggtgaagcgatttttgactatcactttacaaaaaggacaccaaaagggtggcggataactattccataagacaggcttgcagatatatttttttcacatgcactaactgacagtgcaattcattcactactggttgctgtccattctctgtattctcacatatacttattacagacagaacactaaggagaatgtatatggatttttcagacatcggaaatcagattcgtgccaaacgcaaagctaaatcctggagccaggaaaaactggccgaggaagttcatctaagtgcagcatatatcggaatgatcgagcgcggcgaaaagatccccacactggaaaccttttctgtaattgccaatgccctggaagcctcagcagatgaacttctctcaggagtcatcagcgccagccatgaagcaagaatgtcaaaatatgcggaacaaatgcactctcttgatcacaaaagccagaaggtactccaagagatcattgaaatatttttaaaaaactatcaaaaataataaccgacaatttaagaccagcatcggtttttaggaaaccgatgctggtctttacattctctctcttattcttcttccaaatcattggtcagtttaaatctgtccaatacatagaacagcaggcttaacagcatccccactacacatgccaaaaccataccttttaattcaatctgtccaaatctgacagaaattcccgacaaaccggttacaaatattacagaggtcaatgccagatttctggatcgtccgtaatccacacggccgtctaccaggatccggataccggatgtaccgatcataccatacagaaggaaagaaatcccaccaatgaccggacctggtatggtgctgataagtgctgaaagtttgcctacaaaggagcagacaatggagagcaccgcagcaccgccgatcacgtatacactataaaccctggtcacagccataacgccaatattctcgccgtatgtggtagtcggcacagaaccgataaaaccggagatcatggtagagaagttatccgcaaaaagggagcggtgcagtcccggatccttgatcagatcctttcccacgatctttcctgtcacaatctgatgcccaatatgttctgaagcgatgaccagaataaccggcagaatgatcaagattgcctgcaggttaaatttgggcgcggaaaagttgggcattgcaaaaatggaggcatttgccacctctgtaaaatctacgataccacagagaagggctgccgcataacctgcgatgatcgcgatcaggatggggatcaccgacagaaatttacggaatacaaccgacccgatcacggcaacacccagagtcaccaaaaacacaatggcatttttaggattcacagcttcatccagcatccccgcattgctggctgccgtgcttgacagttccagaccaataagtgccaccactggtcccatagccgccggggggagcacgatatcgatccagtcagaaccgaacttataaataatgaatgacagtatacagcccaaaaatcccactgccacaaatccgcccagcgcataagcatacccaaacttactgatgacaatgctggccggagcgataaaggcaaaactggatcccagatatgccggcgcctttccctttgttatcagtataaagagcagtgttcccacgccgttcataaacagaaccactgccggattgataccaaacaaaaatggaaccagcacagatgcgccaaacatggcaaacatatgctggatactgagtggtatcagaagttttggcggaactttctcttccacctggataattcttcgattttccacaatatttctcctctcttacatccttttcggtttattttaacacaacaggctgtaatctgccatacaaaaatcgacgtttttacatgaatggcagcaatacttggcaaaaaggcctgcatggaattttcatccatgcaggcctttcacccaatccctatttcatgtccagttcaaacccgaaataacgcaccgcattattataggaaatccctttcacaattctttccagcatcttcatatccttcggatactctccgttttctacccaattgccgatcagctcacaaagtatccttctgaaatactcatgtctcggataagaaagaaaacttctggaatctgtcagcataccgataaagttaccgagcagccccaggtttgccagagatgtcatctgttttgtcatccctgtcttatggtcattaaaccaccaggcggaaccctgctggatcttacccacagcgtcagaattctggaaacatcccacaatggttccaatggcttcatcgtcattggggttcagactgtagagaactgttttcggaagatttcctttctgatccagggcatttaagtaatccgcgatctgtcctgacggcgcgtaattgttgatgcagtcatagcctgtatccggccccaattttgcaaacatgcctgtattattgtcacgcttgcagccatagtgaagctgcatggcccatcccatctctgcgtattttgcagccacaaaaagcatgaacgcagttttgaactttaactcttcttccctggtaacaggctcatcattcagacgtttctggaaaatggactctatctcctcgtctgctgccggaacatacattacaaattccagtccatgatctgatgcacggcatcccatctcattgaaaaatgccattctggacttcagagctgccttcaaatcctcaaaggactgaatgtccatatcggcagccgatgccaatgtttccagatactggccgtaatctggtttttccaggttcatagccttgtccggtctccatgcaggaagcacctgaaccgggaagctgtcatcctctgcaaggatcttgtgccatttcaggtcatctgccgggtcatctgtggtacagataagtgtcacattagactggaggatcagatttcttgcgctcatggaaggctcctgaagcttttcattgcacaggttccatacttcctccgccgtgtctttgtttaacacacctgtatatccaaagtatctctgcagttccagatgactccagtggaacagagggttgccgatggctttttccagtgtttccgcccatttctggaacttctccctgtccggtgcatctcctgtgatataacgctcctccacaccattggaacgcatctgacgccatttgtaatggtcgccgccaagccacacctgtgtgatgttctcaaactttctgtcctctgcgatctcctgcggattgatatggcagtgataatcaaggaccggcacttttgccgcaaaatcatgatataattcctgtgccgtaggggtgcttaaaagaaaatccttgtccataaattgtttcataaaaaacattacctcctctttctgccggacaccattttatgggtacctgcatttatttttgctttattttatacatatcccatcagactaggcagccacagactgagctgtgggatataagttaccagcatgagcacaacgaaaatcgctgcgaaatatatcaaaagttgtctgaacacagtctctatcttgacatttcccaccttaacaccaacaaacagtgtagtgcccacaggcggcgtaatggttccgatacagagattgaagatcagcatgataccaaagtggatggggttcattccaagtgcagtacacactggaaggaaaataggtgtaaagatcaggcaggcaggtgtcatatccataaaagtacctacgatcagcaggatcacattgatcagcaggaagatgacgatcttgttgctgctgatggccagcagaccgttggatacggctgtgggaatattggtaaatgccataacccatgacatgatactggaaacaccgatcagaaaaataataatgcctgtcatctcagcgctttccttgaaaatcttcggcagatctttcagactgatggaacggtaaaagaacagtgacagtaccagactgtacaccaccgccaccacggacccctctgtagcggtaaagataccgccgataataccgccgatcacaataatgataagcagaagacacggaagagcctgcagtatgattttcatggcttctttaaacgtaaattttgtttttgcgcggtatccctttttcctggcgatgaaatagatgaccagcatacatgccagtccccataaaataccgggtatgtaaccggccataaataacgctgccaccgaagttccgccgctgaccaaagaaaaagtgatcataacgttgctgggcggaatcagaagcccggtaggtgctgtggcaatgttggctgctgcggagaagttgggatcatatccctcttccttttcaatgggaccgataatagagcccatagcggacgctgccgctgtaccggaacctgagatggcgccaaaaagcatgtttgcaattacatttgtctgggccagcgcaccgggggcacgtcctgtgatgagctttgccagattgatcagacggaccgcaataccgcccttgttcataatattaccggccaggataaagaagggtatggccaacagactgaatacggaaataccggagaaaatcctctgcgcgcctgtgaggaccgcaacgtttgtatccatgatcggcagtatggcacacacagaagagatgcccagcgcaaccgcgataggtacacctgccagcagcatgatgaccagcagaaccaatatgatcaatcctgaaactaatgctgtattcataatcgaaactccttttcctcagattattctttcacttcccgatgctcctgctcacagcctttacacaaatccacaatatttaatatggaatacagcacaatgagcacgccggaaagcggtacggccgtgtagatgatacccatggggattcccagggaagctgtcttttgggtcattgtaaggttcataatggtagctccgccgtaaatcataacacttccggccaggagcatgatcaggatttcaatcacgatctccagaacttttctctttgttcctgttattttgtcagccagaaatcccatacgcatatggtctctcttgccgaatacataggctgaggcgagcagcgccatccaggtaaagctgtaggtcagaagttcctcagaaactgtgctggggctgttgaaaaagtaacggataacgatctgatatgttccgatacacaccatgaatgcaaaaataacagcacaggcagagcttaaaatcacattgatcccttttctgaaagaatgtaaggcattcatttactcttccccctttgcgtatttctcgttaatttcctggatatggtcatacaattcctgtatgttcggattctcatccagcatgtccttctgtacgttggatactttgtccttaaaggcctgtacatccacatcgatgaactccacgcccatttcattttccgcaatatcctttgcctcatctacctgcttgtcccactctgtcatctccacctcggtggacagaagcgcagcctgttcaaatacatcacgctcttcatcgctgagtccgtttaaaaatttcaggtttccgatcagcatatccggcaccatctgatgcttgttgtaggagtagtattttgccacctctccgtgtttgttgtttgtaagggcaagctcattattctcagctccgtcaataacaccctgctgaatggctgtgtaaacctcaccaaagctcatgggggaagccgccgcgccgaaagccttcaccatattcacactggcagggctttgctgcacacggattttcaggccttttaggtcctcaggtgtatggatcggtttttttgcgtaaaagcttcttgtcccggcattgtaccaggtcagcacgcggaaccccgcctcatctgtggatgcatagacctgattcatataatccgtatcacccataacctcatggtaggcttcctcggaagtaaacaggtatggcatactgaacacctcatacacatcggcaaatgtctccagattggcagtacccgccacaacaaaatcaatcgctcctgtctgtgtcagctcaatcgctttctgggctgaaccaagtatttcattggggaagatctgtacctcgtatttatctcccagattctcctccacatattctttaaattttaaaagtcccaaatgctccggatgtgtctcagactgtgcatgggaaatcctgacgatcctcttctcacttttaatagaagaacagccgcccagtcccaggaccgtactgacacataaagcaagtataaaggctttctttgatccactcattattcttttcctttcactcttttcctcttctttccgctgagatcttaacatgcgggtccctgtatcctgtcaaaaatctgtggtgcaccgcttttccagacggcactgcacatattttctgtgctccacagactctccttttaagacctccatcagggagtcaattgtcatcttgcacaaaagatcccctctgctgtctatggatgaaagctccggctcacatccaatggaaagctctgaattattgtaacctataatactgatatcctgcggcacggacagcttctttgccctggcatactttacagcacccacagccagtccgtcatctgttgcgatcacaccgtcaaattccagatcttttctggccagcagaatatcccgcaccagatggatctcatttttaatatagaccttgcgttctcccagcaccgtaatatctgctgcctttagcgcatcctcatatcccttcagcttgtgcatggcactgtatgaataggaatcacttagaaaaagtatctgctctctgcctgaggcgatcatagcggaggcggcatcatatacggactggtaatcatctgtgagcatacagtagatgttctccccgtcgatgaagccgttcataataaataccgggatctcttcagaagctttcttaatataagtaatatcttctccatactccttgtcccccgcgtaacaggaccctacaagaagcagtgcgtcaatgcgcttctgcaggatcatctgcacagaaatctccttatcctcctgctcgtacccgctgcagtataagatgcagtcatacccataatttctcaggttcttttccagatatgccacagcagatgccatataatgatctgaaacactgggacagatgatccccactgtcttcatggagttaaggctcatgcctctggcaaatacatttggtatgtagtcattagccgccatgactgcccgtaccttctcttttgtcttttcactcaccttggggctgtcattgaccacacgtgagacggtggcaatggaaacccctgcgagtttcgcgatatcgtatatattcataattccactttcctttcgccgcggaagtgtaagcccttacactttatttttcattatacagatagaaaaaagaaaaagcaattctttttgccctcatatttttcacaagtttcctcttgtatttttgtgaaattttcataaatttcttattttttctcggattttgaaaaatcatgttgacggattcccctgcaagttgtaaatttagtgtaagcccttacatttctaactttcctataatttggaatcggaactgtacattattaaggaggatgataattcccatgcagacttatctgaagatccatccggatgacagtgctgccgtagcgctggcacccctgacaaaaggcacctctgtccatttggacaacaaagagcttctgttatcagaagatataccccagggccacaagtttgccctgaaggacatccgggcaggggagaccgttatcaagtacggctctcccattggactggccaaagagaacattgccgcaggctcctggatccatacacataatatgaagacaggcctgggagagcttcttacctatacgtatcacaagaaggcttctgagcttccccccacaaaggaacgcttctttaacggttacagaagaagcaacgggcaggtcggtgtccgcaatgaaatctggatcattccaacagtgggctgcgtcaacaacgtggcctctgccatcgaaaaacaggcacagatctataagaccggaaccatagaccacattgctgcctttccccatccctacggatgttcccagatgggggatgaccaggagcacacacgaaggatactggcagatctgatcaaccaccccaatgcgggaggtgtccttgtgctgggccttggatgtgaaaacagcaatatcggggaaatgaaaaagtatattggtccctatgaccccaaaagagtccgtttcctggctgcgcaggaatccgaagatgaaatcgaggacggacttgccatgatccgggaacttgcagagtatgccggcagcttttccagagaacctgtcagctgcagggaacttgtcatcggcatgaagtgcggcggcagcgacggtctgtccggtatcactgccaatcccaccgtgggcggattttcagatctgctcatctccaagggaggcacaaccattctcaccgaagtgcctgagatgttcggcgcagagacactgcttatgaaccgctgtgctgatgagaaactgtttgacaagactgttgacctgatcaatgactttaaaaattatttcaaaagccataaccagaccatttatgaaaatccgtcaccgggcaataaaaaaggtggaatctccaccctggaagacaaatctatgggatgcacccaaaaatcaggcagtgctccggtaaaaggtgtcctctcctacggggagctggtaaaggaaaagggactgaacctgttaagtgctcccggtaatgatctggttgcctccactgcgctggccgcctcaggagcacatatcgtcctgtttacaacaggaagaggtactccttttgcctcccctgttcccacagtgaaaatttccagcaactctgcactttttgaaaagaagagaaactggatcgacttcgactgcggtcccatgacagaaggcgtggccctggaagaactgagcagccagcttttcgagtatgtactccgtgtagcttccggggaaaaagtaaaggcagaggaggccggtttccacgatatggctattttcaaacaaggggttaccctttaaccgcatcccattttgagcagtctgtgtatcgattggatcctaatgtaaatctatcaacaggggaataaaaatcatgaaaaaactcagttatcagatattaaaagaaatgaaccacagtggttatcttctcccggaggctcctgaacgtgtcctccagttcggggaaggcaattttatgcgtgcctttactgaccattttattgatgtgttgaatgaaaaggcaggctttaacggcaaagtcgttcttgtacagcctcggcccaagcgccccggccacagcctggcggatgacctgaacgcccagcagggactctataccctgtatctgcgcggctttgagaacggaaaaaaggtcagtgacaagcgtgtcatctcctgtgtcagccgctgtctgaatgcctatgcggactatgacgcagttatggcctgtgccgcaaatcccgacctgcgctatatcacctgcaacaccaccgaggccggaatcgtatacgaccctgcctgtcggtttcaggacaaaccggcctccagctttcccggcaagctcacccagtttctctaccggcgttatgaggttttcggcaaagaaaagggaaagggctttgtgatccttccctgcgagcttatcgcagaaaacggaaaagagctgaaaaaatgtgtgctttcctatgccgcacagtggaacttggaggaaggtttccttacatggctggaggaggagaacttgttctgttccactcttgtagaccgtattgtcaccggctttcccaaaggggaggaggacgcgctgaatgaggaaaacggctacctggatgcagccatggataccggagagatttttgccttctgggtcatcgaaggacctgccgctttgaaacatgagcttccttttgagaaagccggacttccggtcctcatcacccataaccacagaccctacaaggagcgcaaagtgcgaatcttaaacggtgcccatacctctatggtcatgggcgcatacctggctggatttgatattgtgcgggactgtatggaggatgatgtggtctgcgaatttatgaataaggctgtccacgaggagatcatgcccactctgtctcttcccagagaagagctggaaagcttcgcttttgcagtcacagagcgtttcaaaaacccatttattgaccatgcactgttgtccatctgcctgaattctacttctaaatggaaggccagggttctaccctcgttgaaagcctatgcggaccggacaggagaactgccgctgtgccttacagcctcctttgccttttatctggcattttacagaggagcggaactgacagaggcaggacttgccgctgtacgtccaaatggtgaagtttataccgtatctgatgacaggaatgtgctctcattttttgcggcacataaggatgatagggaagaggaatacgtgcatgcagtctgtgccaatgaagaactctgggatatggatctgtgctctctgcctggatttgaggccgccgtcacagatatgctgaagaaaatccggcgagacggcgcatacgaagtgatgaaatccgtctgctgatcctgcaaataagaatccccctatggaaaaccggaagtttcagctttccatagggggtacttttatattctggatccagatgacaccgccgcatagaatatacttgtctgctgttatctgcccgcctttttctctgcaacagcacagattgtggtatctcgcccggtaaaagccttcccagccacatcatcataaaaacctgtacagcaaagtcctgcactctctatctcctttttcagagactctctgctgtagcgctgattccaaagattatagcagtgacaatcctcttctgtgaccaccaaatactgttccagggtattggctgtctccggatatttgtaattgcgctggatgagcacatgaggcccggctgaccagaacccctcctcctgatactgaacggtctccagttcttgaaaaggcagagtctcggtaaagccgtcaagaataagaatcccgtcctgtttcagtgctctttttattttgcccaatagagttttcctgtcctttggaggcagtacaccgaaatcacaataaatcaaggttatgacatcaaatgcctcctcatagtccatttctagataatttttatattcataccggatgtccctttttgttttggaagcgtgttctttggcgtattgaatggaccgcctggaaaaatccagacctgtcacctggaatcctctgtcatcaaacagttctgcataaagtcccggtccgcatcccaaatctaatagcttctttcccgctccacccctgcagcgctctgcaatccaatccgcggatttttgtataaacgcatgcttcctggtcgccccttccacatccgggtccagatgtgcctccaacatatatctggaaatattttcatcatcccagaaagcggaggagctggcttcgtatacctgtggtttttgtttcataaacccgaatagtttcctgctgatattttccaaatactttctccctgtccttttttactgtgtctatcagtttccatcgctgcagtttgccgcatcaatggcgatcactgtcagcagtccgatcagttcatcatcccggcaggcatagtcgatcacataagtgtctccccaatgaaacggctctttcctgatatgcatgatcggacagcattcctggcggacatcataatcccactccaaaaaatccccttccactctccagtcattatagtcaatctcatattttggcttgaacagcgaaaaacgcttttgtatgctccccatagtcctgccctccacaatcagctcaaatctgggcatgacagtcatcagcttctctctcaccatacccacttcctcaccggtgtcgtgacggtaaatgtgtatcttatggccaatggaaagaaattctcccttgacgaaatactttggcgttccattctcatcgtacacatcataggtatccgtccaggaaaacactctctgttttatcagtaatttcataaatccatcctccgtctgcacttttttaccattcaagcagcacagctccccaggttagccctgctccaaatcctgacatgacgatcttgtcccccttttccagcctttgatcacggttcatctcatccagcaaaataggaatactagctgctgacgtattaccgtgccgctccagattgacaggaaatttctcctccccctccttcagcctctttgccacagactggataattctgctgtttgcctggtgcagaacataatattttatctctgccttctctgtcccgttcttttcaagtacctgcatgatacactccggcacttttttcactgcaaatttaaagacaggctgtccgtccatggctacatagtccgcttcctgtgcaccgggcaccaacaggtttttcatctggcgggcaccgcaggtaagaacgctgtcacctctgccgtctgaccactggaccatatccataaacccggtttcatcagcttttaccacaacagcacctgccccgtccccgaacagcacacaggtacctctgtcctcccagttgaggagctttgacatggtttccactccgatgatcagggcattttgataaattccgcttttcatataggcctgaacagtattgaacgcaaaaatgaatccggagcatgccgcgctcagatcaaatcccacggccttccaagccccgatctccttttgcacctgacaggcagtattgggaaaaaaagaatccggcgtgcaggtagccactatgatcagctccacatccgcggcgtccatcccggcattctccaaagcattttttgcggcacggcatgccagaattgttgtattttcttctttcgcaattcttctctcccggataccggtccgtgtggagatccactcatcgtttgtatctaccaccttagacagatcgtcatttgtcacaatattctcaggaactgcactgcctgttccgattatcctagctaccatactcatcctacctcttattctatcatattttcaccggtttgcatccgggaattcacttaaaccatcaaatagtttgattatcaaatcttttctttcaaagtatactaagaaagaggccgtttgtcaactacacaaacggcctcctgcctattatttatagtaaccgtttgctgttcgctttatatccagttactattcatcttctttataaattttctgtatttcctgggagagttcccggctcagatcatccaggtcgattcctgttcccacgcctctgtatgcagagctgtccggcttttgcccgcggttatagtcctgctcccgcagctttgccatatccgggatttcccttgtcttttcccccggctcctctgcctgtctgcgctgtgcctgggcgctgttctggcttccgcttctttgttttccgcctgcctgtcccctggaaggggttctgcctgaggttgtctggttccggttcttctccgtggttttatatacggttttcttttttgtcttcttttttctgcccggcagtgacggaaggctgaacttccgtttcttccggttaaacagaggttctctgctgctgcctctgctctgctttttctccctattgcgaagaagtggtgctgcctgcaccgcaattccaaggaaagccaggatcagccccagcagccaggtccccgcaccgccgtctttgcctgtcatggaaaacaggatcctgatggctcccaaaccaccgcagaagcctgtaatgccaatgatcacatactcctcatatcctactgccatggtcgcagcaaagattccaatggcaatacagatgatcctgcctgtatttgtaggtgcgcttaaaaaagaattggccagcgcatatacaagacctgcacacagcacaaaaatccccagcttatagaagatccaggcaagtgcacccagcactactgctccggcaattcccgctatcaccgcgtattttgcctcatgcagaaaatagtagcctgcgatcccgccgccggcagcaccaatgataaacccaaggatactgccccagatcttcctgagcttgtagcccataaaacaatttaacagtgcaaagacaagccctgccagcataattcccgtcgtatacttttccataacattcccgtactgggaagtcacaatgtttaaaatatctgccggattcatatcgatcaccttaccccttatctgttatgtattcattctccacctgcagtcccacctctgccctttacagaactgtgaccaaggcgtcagccactctctcccctgaagctgttttttcaccactgctgtttacttttgctttaaatatatatttttgatatatttgagggtctccttttcccctttctccgccaacatacggaggaggaattccaaatcctcatttgtcttctcatgtacaaaccagagcctctccctgctttttaaaaaatatgccagcggcgcctggtctgtatacgttccgggattatagaccctggaagcgctgatgcggtccatgaccatctctgcaatgtatttcttcggcatggggacaccctgaatgactgtgtcgcagttcactccgtagtccacccagtgctcaaaatgatgtttattccttccatagtgatggatccaggaggtagacagccctgtgtcttccctctccgcattattgggacttctgttgccctgataatacctgcatccaactgaaaactctgtccaggaatactttgacaggtcatgcagcaagccctgccggtacagacctattttaaaacagtagcgcatgaccagcagcttatggctggtaattgtcttgaaatgtgcccatatatgcattacgctgtttcctgctttccgattaatattgcaatagttctcgacggcacctccacagcccttttaccctttcccttctgctttgtcgtcttcacatctgcctctgtaaaaacctgatcctcctgtctgctggtgctcactacgaatttccacacagctcctttcggaagattgggcagtgcaaattcatggggcatccagtgcaggttgtaagccacaaataaaaactctttctcctgcttcccataatctccgcagtacatcatccccagatgccgcagatttctctcacagggtgcataccaggcctgtgctccgtggtaggacaggtccggatagccaagtgccctatagtccacacctttgagttcctcctgcatgtgcagaatatagtatttctttctgaaggcaatggcctcttttacaaattcatacagtgcctgattggatctgaaggcgttccagtcaacccatccgatctcattgtcctggcaccaggcattgttgtttcccttctgggaatttccaaattcatccccctgaaagataagcggtgttccctggctcagcagaagcagcaaaaaggcattcttaagctgctgcagcctgagtcccctgactgttttcttcctggtcggaccctcagctccacagttccaactgcagttatattccatgccgtccctgttgtcctctccattgtcctcattgtgcttctcgtcataggacaccatatccatcatggtaaatccatcctgatccgccagataattgatgatccccgtctcttttggattcctccggttccggtagatgaaatcctccagcatgttctcatcacttttcaggagatggcgcatgcagtagaggaatccttcgttgtactccgccacattcttgaaagcaggtaccttcccctggtacaaatagccgccgtccacatcgtgaaagaaaagcttcgttctggtcagcagggcatcttttaccagaatctcctggcagataccgctgcccatcagatgaaatccgtccacatggtactgcagcttccagtaatgcaggatatccagcattacagaggggcttactgaaccgtcaaaataaaactccatcaaacattccatccctgccttgtgaagggattccaccagatgagaaaattccctcatagggcggtctgtggcacaaaaagatgccttgggcgcaaaataactggcctctcctgtatatccccagcagtttatctgcttaggcgcactatcctcgaagacaccgctcttgccgccatttttctcatagacactgcttaggcgggcatagggatgttccggccgtctttcactgctctgttcccctgctgtctccctgtaatcataggccggcatcaagagcactgctgtgacacccagatttttcagatattctatcttctgttccaggcctttaaatgttccttttaaacgtaccccggaatttttctgcatggtatattcccgcacctgcagcttatatataatggaatctgacagcgaataagatttaaaatcgccatcctgccatctgtatttctctcttcggaaactgcaccggataatgtctgtctcttcacttttgggctgtccgaaccggcctgtaccggacaggcagaccgcgtaagggtcctgtatcactttattgccaatacggtaattatactcatacctgtcaggggaaataccttctatacagacagaaaccatatttcctatccttttttcttctgaaaggggaatctccttcaccggcattttctcccctgtatggtacagaagaaggaaagcctcctccccatccggaacagaaactgtaaactgataccctttttctgtcctggcaactcccggttttcccggatataccggcaaagcttgtatctcctttgatgcctcgtctattctcttcgtcaagctgtccacctcatttcaatttctcttgttccgaacacaggacctccatcctgtcatgcactgccggcgcgtcctgctcatctgtcatggttatgatcgtatcactggccattaatatagtacgcccttttgggatcagctctgtgccgctcctctgcacagccaccagaaggcagtttttcggccattcgatctgctgtaccattttattttgaagctcgcagttatgacggaccacaaactcctgtaaaattttttctcctgttttctccggcacatgctcgccccgctttctcagcaggttttccagaaggctctcataaataggctgtgatttcacagcggttgccaccaaaaaagctacaatagacactaaagacagagacagcatctggctcacgctgcctgtcatctcaaagatcaggataatacctgtaataggcgcccgcacgatcgctgtaaaatacccggccattgccagcatgatcagattgttcagataagccgcgtcaagtcccaggtactgcactgcaaaggttccgtatgctccgccgatcaaggcccccaataccaacagaggaaagaagattcctcccggcgcaccggacccaaatgaaatgacagaaaataacagtttcatcacaaaaagcagaaggatggtggtaaacatcgcattgccctctgtgataatatcaataatgttatgcccgctgcccaaaatctccggcatgataaaccccagggcacctgccagcagaaacggaatgagaagtctggtcgtctcagctctctttccctgtatctttccaaataaagactgcacaaaaagcgtcatcttattatagaaagctcccatcactcccaggatgattcccagaacgataatatgtccgtaatacttcgccggaatagagcctgttatctcaaactgaaagacagaacggaatcccagaaacctggaggatatgtaatctgccgtaatagacgctgtcatgacagacaccagcacagacactgaaaaattcttgtggatctcctccagagaaaacattacgcctgccagcggtgcatggaatgcagccgaaagacctgcgctggcaccgcaggtaagaagaaacttttcttctgtcttgctcctgtccagtatctttgatactgcctttcctgccatagctccaatctgtatggagggaccctctcttccaagtgacagccctgcaaacagtgacaaaaaacctcccagaaattttgcaggcagcactctccaccagacctgatttaactttcctgccatctcaccttccacctgtggaataccactcccggagatgaatgactcatattttaccagacgccctacaatacaggccagaataaacagaaccaaaaaccagcatcccgcgatcaggggatactttcttccatattcaaggacaagattcatacccctgcccgcatactccagaagcactctgtataaaagcaccacaagtccggccacgatccccactaaaaagccttcggctgtcagaatggacttaaaatgctctgctctcttgatcacataggaagtgtcccgcttcacaatgattcctccctctttgatacctcgtacgcaatcgccgggacccccagcgattctcttgtcttcttctgaagactactctcattatacgtgtgaccccataaaaatgcaatcgccaattcgtaactgttgcaatcttttctttaatctgatagtatgaaagcagtccaaatgcagtgttttgccgtatttggaaaaccgagaggtgagagtttggcaggcctgcgcatctgctctgctgaacccttatactgaaagaaaagaagagaggtaacacatatgagtgaagaaacattcacagcaaatatcggcggctgcgacccaagcgactgtgcttcctgcagctcaaactgctccagcgccggcaaaggttccattcccagggttccaaaccccacgatcaaactgaccctggaagacaacaccgttctggagtgcgcagtgctcaccacattcccggtggaagacttcggtgagtttattgcccttgttcccctcgacaaggacggtaagagcacatcaggagagacttatctgttccgctacgcggaagacgaagagggcaatcctgtagtgaccaatattgaacgggaggatgagtacatggctgccgcagagagcttccatgaatttattgccggtcttcccagtgaacaggatatggaagaaaaagagtaacaatgatggtaactgtaaagataccgtaccgttacaaataatctccatgcggaggatctgccatgcatgattttaaaatctgggacagccatgttcatcttttcccccctgagatttaccagaactgggagaaatacgctgtcagggacaactggtttgcccttctcacaaaaaagccggaaaacggcaagggaaccgaagaagcctgggccaatgccgaggaagctctggaatgcgcagacaaagccggcatttacggtcttgtcatgcaggggtggtactggaatgacgaaggcctgataaccatgcacaacgattacatggctgacatgatgaaacgccatcccgacagactgaaaggctttatttccatcaatcccaaattccgcgaaaaagccatctccgaaattgagcggtgtgccaaactgggcttcaccggtatcggagagctgggtccagggggaaacggatatgattttgaagatcccaatcttatagacgttctggagtgcgcacagcattatggtcttgctgtatgcatccactgcggagaaccggtgggccatgcctatccgggcagggattttacaagccttgcccccattccggagctggtgaaaaaatacccggacttaaagcttattttagcacatatggggggcggactgcccttctatgaaatgaatccaaaatacagcggaaagtttgaaaatgtatattatgacacagccgccaatcccctgctctaccacatccgaagctttcgggctgtcatctccatgatcggctgcaaacggctgcttttcggaagtgatttcccgctgctcctctatccctccaaatgcagggagatggatttctccatgtttgtggaggatatcagagaacatgcgggacttacacaggaagagtggaatgatgtgatgggggataatctgcttcggtttctgaaataatgaaatggattcatgaattgccagccggaagaatacaagtatatccggctggcgctttttgttttgtcatattgcgcagatgggatttccccaaatttctgcgcttttactggactatccacacgaatatcgaacagttccgcttagatttattatttctgtaggagttctttgatccgctccagcggaatatctaacttttctgcaactacttccgggggaagaatgtcaagaaaacggaccgccgcattttccagacccatctgttttccccgctgttcgcctatttgttcgccttttcgctcaccttttcgctcaccttctttttttgcatcttcagtcaacatactgtacagccatgtcatactaagcacctccttaatctcttccaattcctcttttttcaggaatttttccgccaacgtgtacaaaatagattccgttttctttagttcctgcgttgcctcctggctggccgtaagccgaaaagcccgctcaatcttgtctttctgggaaagttcgcctcctaataagggaagcagggaaagctttgccaaatcttttcgcgatagtttcctgccctcttcttgtttcttttccagttttcttagaagtttgtcaccatctctgtcagacaacatgacagggaccactttataagtgtttttaccacatttcatagttgttacaggatgttttacgctgccgctatatataacataggtaacaacatccattccaaactgatagctgataatactctcataaagccggaaccgcctcatatcctcgattcccccatccctgctctggaactccagatggccgcaggagtcatcttccatgatcagattcaaatcctcatagaatttttttagttccagatggatactctctgtgggagctatccctctgaccttctgcttcacgcccgccataggcagcagttccctggcaaagaaagacactgcggtcttcatagccttatcttcatgttccgaatggacagggaacttctgacgcacagcggacggcctggattttttcactgtacctccttacaggcactctgaaaaagcatccgcttacacagcatcgcatttgtaaatatatacagacatattatgtctttttctatactatagcaaattattattttgcaggcaacggttttaccatgatttttattttttaattgtttaattttttatttcaatgagattttgtcctgaaccggacatataagacttttattatgaaagataaataagaaaagtatagcaaagcggataatctaaacagagaataccgttgtctgaaaaaggtgctgcgctgctgttataaacagtatatgaaaaaaccggataaaaaacaagagttattttccggttcctgtattttacagcagcagctatttttgttcacagccgctgtcccgccaggtattgcctgcaaatgcaaggcaataccgaggcagctatctgaatcaccactggatctccacggaaccttctcactctgccaggcttggaatctccacctgtatctccacatctctgctgtaatccacattgtcaagatgaaaaccgaacatgtgatagaaatcttcccagtacccttcaatatcagaaagctgctccacattctctgtatttacttccttccagcagtccataaccgcatcctgtacctgaggcgccagttcccagtcatccatgcggatgcgtccctgctggtctgtggggatctcctcctgaaagagtttgtcatggaacagacgtgaaatctgctcaatgcatccctcatgtgttccctgctctttcatcaccttatagagaatggcaaaataaaggggcacaatggggattgctgcgctggcctgtgtcacaagggctttattcacagaaatatatgcgcatacaccgggatgcttttcccgtatcctgcctgcggtttctgtcaaatgctttttcgcctgtccgatagttccttctgtataaataggataggtcagttccggaccgatgtaagaataagccactgtcacagcgttgtcagagagcacaccggcatttgtcagggcatccatccagtccatccagtcctcaccgcccataactttgatcgtaccttccagttcctcttcattagcggcttctactgtctttgtcacaatggtattgtttctcagatccaggctcttctctgtaaaagcaccggttgtggtctttaacgtggaagaccaggttttattatctgcagtagtccttctgggtgctgccagactgtagatcaccatatccacctgacccagatctgctttgatcatctcaatggcctgctgctttacttctgctgaaaaggcatctccattgatggattttgcgtagagtccctcctccttcgcaaacttttcaaaagctgccgtattataccagcccggtgtagcagtccgcttgccggaagacggcttttcaaacataataccaatggtagacgcctgacatgcaaaagctgccgtgattctgcttgccagcccgtatcctgtggaagcaccgatcaccagcacctttttcggtccacgcacctctccttttccctttacgtacgcgatctgccttttcacattttccctgcatccttccggatgtgctgttgtacagataaattcccttacctttggttcaacgatcatttccctatcctccgactttctaatatctaaaagctgaaaattctttccacttacttttatcttctaatagtttgattaccaaagtatattatcataaatacacatgaaatgcaacccggtaattttattctgtttccctattgacaaagcgacactagtgtcgcataattaaaaccaacacatataccgcaaatgaggtgatacccaatggggacaaaaggagaaaagacaaaacggtttatctgtgagaatgccttccagttgtttgcagaaaaaggttttaaggacgtaaccatgaaggatatctgtgaaaagacaggactcagccgcggcggcctctaccgtcattatgaaaataccggccagattttcctggagatcatccgtgtactgatggcagaccagcagaacgaatttgaggagaaaataaaaaagaacactccagcacgccaaatcttatgtcaagtgctggaccgctatgagggagaaatgattgacagccagcattctctcagcattgcaatctatgagtttttcagcagtccttctatatctaaaagcagcaattccattcagcagcagtatgaggcctcaaaagagatgtggactgccctcatccaatacgggatacagacaggcgaattctgcccggtggatccggaagccgtctatgacctgatcgtattttcttatcaaggtgtccgtatgtacagcagactcatggaaatagacgacgccataccgaaacggatcaccagccagatcaaatctctgttattgatagaaaggaaggaaaaatgaaaacagtattttacagaaacgaacttccggaccgggcctttataaacccttcagatgcagtagaccctatacccggttttcccaaaatttgtgtatccacatattcacggaagatcatcgagaaattcgcctcccttgacggtgtgcagatcatcgcacatctgtataccgccaacggatgcacacctatctataaaatttcatataggggcagggagatagccttttatatgtccctggtaggcgcccccgcatgtgtctgcggttttgaggaggccgccgccatgggcgctgaaaaatttgtattctttggctgctgcggtgtcctggatgacaaggcagtggaaaaccggcttatcgtccccaccggagccgtacgggatgagggaaccagttaccactatctcctgccctcagaagaaatacagcctgacagccactccacagatatattaaagtcatgcatggaaaagtgcggatatccttatgtctgcggcaggatttggacaacagacagtatataccgggaaacacctcaggaaatcgccgcctggagagacagcggatgcatcggcgtggaaatggaatactctgcccttctggcagcggcaaggttccgcggtctaccgctgatccagttcttctacggggctgacaatctggactgtcccacatggcagccccgggatctgactgactggggtctatatggcgctgaaaaatatatggccctggcctttgaatgtggtttggccatgtaataaatttattttgttgtacttccaaatcctccgtttctgacttcacacacatcgtcatcaacggtaattccgtattccacaaagattccctgtgcaaagccggtgccggcctccacgcacactgtttttccttcgttggaatcgttggttatctttacaaagatatggccctcattgtctgagtaaaaataatcgctgtcgataatgccaactgtattgttgagctgcagacggtatttgaatcccagcccgcttctcggatacaatttgagtacccatccttcatccatctcagcccggacccctgtggggatttttacggtctcacccggtttcagttcaaaagagagggggctgtaaaaatcatacccggcactccccgcagttgctctcttaggaagctggatactgtcatatactgcttggatctccgcctctgtggctttgtcaaaggtatctttccatccttttgcaaactgttctctgctcactttatgaaactttgctattcttctcatgttcatctcctgtatgttatttttatctactgtctcaaagtaaaatccctaaatgcttactcatgcagcaccacgctgccctcctccagggatttctgtacgtcgatcaccctctgattggagcttcccttccattttagggcaatgtctttcttctctgtgtcgaatctgccgtctaccagcacgtccaggtacctgagtatctcttttccctgaagctcctcccacagatatccggtataaagccatatggtcttggccggatatttttccttgatctcttttgcaagtgctgtcacttccggcacattttgaaaataaaggggatctcccccggaaaatgtgattccggatatgtagcttttacccaattgttcaaaaagctcttcttttgccgcctcatcaaagacaagaccgctttgggggtcccaggtaatgggattttgacagtctttacagcaatgggaacaaccggatacccataaaaccaccctcagtccgtccccgttcagcatgtcatcttttgtgatattgtgatacctcataaagcttccctcctgccgaatatgcgtgacacctaaatgtgtccctatatgtccctatttttgcagcaaatgctgtatgataagataggaaaagggagaaccggcagcccaaacagcaggcagcctgactctcccctcaatattttaacgaattactgtgcgtccttcggcacgtccttgatgctgaagctgatccttcccatcttgtccttgcccatgcagattacctttaccttgtcgccaagtgtcaggacatcctcaacgcggttgatcctctctttggcaattttagagatatgaaccataccttctttgccgggagcaaattctaagaatgcaccgaaatctttgatgctcacaaccttgcctgtgtagatctgaccttccacaaaatcagtagtgatcactttcacataatgaagagccttatccatcatcttctgatctgtgccgcagacagaaactgcacctgtgtcatctatatcgatcttaacgccagtctcgtcgataatggcattgatggtttttcctctctggcctaccacgtcaccaattttctccggatcgatctggatctggatgatcttcggtgcgtactcattcacatggtctctgggagccggaatacatttctccataacttctgacaggatgtactctctggcttcttttgttgtggcaatggcttcctcaatgatgggccttgtcagaccgtggatcttaatatccatctggatagcagtgataccgtcatgtgtaccggccaccttaaagtccatatctccgaagaagtcttcaagaccctggatatctgtcagtacaatataatcatcatctgtttcacctgtcaccagaccacaagagataccagctaccggtttcttaattggaacacctgctgccatcagggacatggtggatgcacagatacttgcctgtgaggtagagccattggactcgaaagtctctgatacggtacggatcgcatacgggaactcctctgttgtggggagtacaggaaccagcgcacgctctgccagtgcaccatggccgatctcacggcgtcccggtcctctggaaggcttcgtctcacctacagagtaggacgggaaattataatggtgcatatagcgtttgctcgtctcaaattcgtccagtccgtccagtctctgggcctcggaaagaggagccagtgttgtgatggtacaaatctgagtctgtccgcgggtaaacatggcggaaccgtgtacgcgcggaatcaggtctgtctctgctgccagaggacggatctgtttgatctcacggccatccggacgcttatggtctttcagaatcatcttgcggactgtctttttctgatactggtaaacagcatccggaaccagggccagccactcttcgttctcagcaaaagcctcttccagcttctctgtaatggcacggatgttgccctctctggtctgcttgtcatctgtaaatacagcttcttccatggcttccggtgtcacgatctccttgatcgcagcaaacagctcttccggaactgcacagctctcgtaagtgtgtttttcttttccgcactctgccacgatcttatcaataaatgcaatgatctcacggttcacttcatgagccaggaaaattgcctcgatcatcttgtcctccggaatttcattggctccggcttcgatcatgataactttttctcttgtagatgcaactgtaagctgcaggtctgagatatccttctgagcaagtgtagggttcaccaccagctctccattgatcattccgatcatggttgccgcacacgggccgtcaaaagggatgtcagagatacaggttgcaatagaggaacccagcatggcagcaacctcagggttacactcagggtctacagacattaccatattgttcagagttacatcatttctgtaatcctttgggaacagcggacgcatagggcggtcgatcacacgtgaggtcaagatggcatgttcacttgcttttccctctcttttgttaaatcctcccgggatcttaccgactgcgtataatttttcttcgtactcaacactcaaggggaagaagtcaattccttctcttggtttgtcagaagcagtcgctgttgataaaacggtggtctcaccgtaatgcatgaatgccgcgccgtttgcctgcttggccacacggtcaacatcaacggtcagggttctgcctgcaagttccatggtaaaacttttatacatattatatctccttttcgttcttcggcgttgcgctgtccgaaacaactgaaaaatgcgtttccccacaggaaatacccttttcagtggtctcggttccagtatcttcgccgtgataaaatggggcggaatactccgcccctaggtttgactgattattttctaagacctaacttctcgatcaaagcacggtatctctcaatatcagttttcttcagataagcaagtaaaccacgtctctgacctaccattttcagaagacctcttctggaatgatgatccttgtgatttgtttttaagtgctctgtcagttcctcgatccttgctgttaaaactgcaacctgcacttccggtgaacctgtgtcgcccggtgttcttgcatattctgccatgatagcttgtttcttttctttagaaatcattgtatgttcctccatatttttttataatcgcctctgattaagaaacggtcggagtttccaattcctgaatcagggctgtactcatacttgttcagtatagcataacggttcttagttgtaaagatacattttcagaaaaaacgtgcgccccagacagcctgttccctgtacagattagatactttgatacctgtggctgaactgctggcatgtaccacctggccgtcgccgatatacatgaccacatgataaatataaccgttttccgcgtaaaagatcaagtctccgggaagcgcttcctccacggatatcctctgccccgcatttgcctggtcagccgccaccctcggaagctctaccccaaagtcgctgtaaagggtctgcacaaatccggagcagtccgcaccgttagtcaggcttgtcccaccccagacatagggattccccacgaactgaagggcataatccacaagggaagtgcgtaaatccaggggattgatgacaggcaccggctccgggtcatccacaggatatgccagcaccggctcttctagtcctgtgatctccatgtaatccgcctcatcggtaccaaacatgtccagatacaagttgcatacatatcccgtcatttcccctgaactgatataggaccattccccctctgtactctccacataacaaagcccgtctttaggaagcttgccgatgatcgccgtatctgtgccggccccttccctgatattcagacaggtgtccacatctgccactgcgcagcactgctctacaggcacattctctgccggttccgccattacaggcactgctgtcagaaggataccggttcctgccaatgtataactgatttttttcataaaattccgcataaaatactccttttcaaagaaaccattcattacttcctgccgggtcattcccacggccagacgcaaaaagcccgcggctcatctgccgcaggctttttctttggtattcagtacaataaaaacgtatcttttattgtattatagagtattgcctgtattttacgattttattacgattgcattacaattctcttatcttcctctggttcttcgtccaggatcgagaacgcaatgttggttgcatggtcagccacacgttccagacctgatatcagatccgaatagatcatgctggcgtccggtgtacattcattttttgtaagacgctggatatgggtctcctggagatgtctctccatctcgtcaatgctgtcctctaattccaagatctcctggagatgcttctggctgttatgggagaacatgtccatggagtaggtcatgattctgataaccttgtccatcatttcagccagctccttctgggctgccggactgaactcaatattcttctccctgcgctcaatggctgaatccgccacattttccgcatggtctccgatcctctcaatatcgttcaccacatggaagagaccgccaatgctcttgatatcatcaatgggcagtgtactctggttgatcgcgatcagataatccgtgatggcatgattcatataatcaatttgtttttccacccggtaaacctctgcgatctcattctcatccatagtgatcagcgcattcatagccctgtttaaattggtgatagccatattgcccattctctccagctcttttgtagcttccactacagccgtgctgggagaaaacacattggtgggtcctatgtattccagcttgaaaccgctgtctgacacctcttcgtcctttccgggtacgaacagatatgtcatctttactatggcaccggagaacggcagtaagatcagcacctggaaaaccttgaacagagtatgggcatttgccacgctccgccctatgttgcctccggaaagtgtggtgatcatattctctacccagttctctccaaccagaagcagaactgccatgataacggtaccgatcacattaaacagaaagtggatcagtgccgcccgcttcgcgtctttgtttccattcaggcttgcaagcagcgcggaagtacatgcaccgatattacatcccaaaattatgtagaaacagattcccagtggaagcagcccctgctgtgccatcaaaagaagtatgctgaccgtcaccgatgagctctggataatggcagtgatcaaaaatccgatgaaaatacccaataacggatttttcagattagagagcagactgatgataaatggtgattccttcaggcctgccatgcttcccgacataagcgagagtcccatgaacagcacaccaaagcccagaataacctcaccgacttttttcaccttttccttcttgcagaacatgacaatgatcacacccagcatcaggaacaccggggcgatctgggaaaggttaaaagctaccagctgtgatgtgatggtggtaccgatattggctcccatgatcacacctgctgcctggaacagattcatcagacctgcatttacaaagctgactaccattactgtagtcgcactggatgactggataatggcacagaaaatcataccgaacagcattcccacaaacttgttctttgtaaagaaagccagaaaactacgcatttttgctcctgcggccttctcaatgctgtcactcatcacccgcatgccgtacaggaacaaccctaaaccgcctatcagcgtcaaaatgtttcctacgttcattcttatctccttggtaaaaaagatttcgttataaactataatagaaaatctgaggtttgtccatcattatttgtcaaacgccttgaaaaattctcgacctttttggacatccacatccaattgtccctttaattcctgaagggagccgaactttctctcgggtctcagataacgataaaaacgcacctccgcgtcctgtccgtacaagtcctcatcgcagtcaaacaggtatgtctccacacccagaaaatgttctgccacggtgggcttataccctacgttggtaattccctggtacattttttccccaatgcgggagcgggtgatatagacgccgttgggcggcagctttttacagaccggggggatcagattggcagtgggaacccctatggtccgtccaagctgccttccatgtacgatctcacctctggtaaaatacgcataccccagaagctcgttgaccttttccatatttcctttttccagctcctcccgtacataggtgctgctgatctcccgatccccgtcttttaatttttccactacatccacagtaaaaccgtaagtttttcccatttgagccaaaagcccgggggaacccgccctgtcatgcccaaatctgaaatcagggcccacagccaggtattttacatgcagacggttcaccaggaattcttttacaaactcctcagcttccatgtgcataagctcatctgtaaaagggcactccaccagaatatccatgccccgctcacaggccagctcctcccgctcctcattggtcagaagtccctttgcaggggtatgtagaagcctcaccacaggtgacacatcaaaagtaaagataaccgccttacagttatcttcttttttttcccgtatgcagttcatgagcttctgatgtcctctgtgcagcccgtcgaattttccaagggtgaccgcacttgtctccccctcgccaagccttggcacatctgttgtatatatcatggtgtctcctttctgctctccgcaaaatcttccggggtgcagaacatggtaatcagccgaaactgttttttcttctcttcaaattcatacaggcctataaaccgctgcccgctgtcatacatgcggactctggtgccgtcttccatctcatcttcggccggaacagcattcccgttgcggagcatcttgtcaaaacgcgccggcgcgtgtacctccccatattcggaaaacatctgctcaattgtaacaacatgagacaaaacagtaccttcttccacagctttttcaacctctgaaagcctcaatgcatcctccacgccgaaacgctccacacgggtgcgcaggagactctgcatacagccgccgcatcccagctcttggccgatatcatggcacagagttctgatataggtgccttttgaacaggtcacagtaaaccgtacgaaaggaagatccatctccaatatgtctatgctgaaaaactccacgcgcctgggctttctctctatttcttttccctcccgggcaagctcgtaaagctttctgccgtttacctttaaagcagaatacataggagggatctgctgctgctctcccagaaagccctgtatacaggagcttacctccgaaggcgcagccgtaacctctctcttttcaagaacagtgcctgtcatgtcctgagtatctgtggtgatccccaagcgcagcaccgcctcgtatgtcttccttttatccgtcagaagatcacacagctttgtggcccttcccagacataccggaagaacaccctcggcatccggatccagtgtacctgtatggcctattttcttttgtcttaaaatgcctcgaagctttgccacaacatcatgggacgtatatcccttttccttgtatatgttaataactccgttaatcaccacatttttcctttatctgtttttcaatatgtcctgtcagattgttgatcacatcatagacggagccctgcatggtacagcccgctgcttttacatggccgccgcctgaaaaatagctggctaccatattcacatccaccggtccgttggaacgcatgctcactttaaattcctgtgtctttacctcgtataaaaagacagcaacctctacgcccttggtaatacgcagttgatctacaataccgtccagatcctttggctccacaccgtaaaattccatatcacgctttctgatacagccgataatacattttccgtccagcagcataatgctctccatcaggcatctgccaaggatctggttctgcacatagcttttctggaaaaatgtctcatcaatgatcctggtaaaatcaattcctttttctatgagctttgccgcaatacgcagggtctttggggtagtagaggaaaatttgaacacaccggtgtcatgggccattcccatataaatggcctctgccgcagactttgacactttttcctcatccagaagtccaaacagcacctcagaagcagaactcacatccggcttcaccacattgatgtccccaaagcctttgttgctcacatggtggtcaatgcagattttcttctttgccttctggtaagcctcccatgccacaccgatgcggtctgacgtactggtgtcaatgacaaagaacacgtcataagcctcttcatcgctgtagactgtcctgatctcatccaaatgtgagagcatggaaaacgcatcccttggcttttccaggtaaatatccgtcttgatctcaggatagttttccttaagataaaggtaaagtcccatacaggaacccacgcagtcaccgtccggacgaacgtgtccggcgatggctgcccttttgatccccttcagttcactcgctatcttctccatcctcatgcacctccgatgctgcgtcttttctgctgacttcatcgatcagcttagacatagttacaccatattcaatggattcatccagaataaaacggatctccggtgtattcctcaggttcactgtcttggcgagctgcctgcggatatagctttccgcactgcgaagccctgctaaggtgtcctttttcgcttccgcatctccaagcacactgatatatgctttgcaggttttaagatccggagccacttccacccctgtgacacttgtcataggctggatgcgcgggtccttgatcccattccggatgatctctgccagttctttatgaacctcagcgttcacccgtgtatttttaatactgttttttctcataaaagctctcctatctcggcacttccaccataatgtaagcttctaccctgtcttcctcttttacgtcactgaagtcctcgaatacgagaccgcactcataacctgctttcacttcttttacatcatccttgaaacgcttcagagatgccagaacaccttcgtagatctgttcttctcctctggtgatacggactttgcagtttctctggaagataccgtccagaacatatccgccggcgatggtacccacatcggaggacttgaaggtctggcgtacttccgcatgaccgatcactttttcctcgtataccgggtccagcatacccttcatggctgcttccacatcctcgatggcctgatagatgacacggtacagacgaaggtcaacaccctcctgctccgcgatggcctttgccgtaacatccgggcgtacattgaagccaatgatgatggcattggatgcacttgcaagggtaacatcagattcattgatggcacccacgccgccatggatcacttttaccacaacctcttcgttagacagcttcacaagactctgtttcactgcttccacagaaccctgtacatcggctttcacgatcagaggaagctctttcaaattacctgcctggatctgtgtgaacagatcatccagggacattttggcttttgtctcttccagcagacggtttttattttcggaaacaaaggtagcagcaaaatgttttgcctctttgtcattttctgttgcaaccaggatttctcctgcgttcggcacgtcattcagacccaggatttctacgggagtggacggacctgcctcttttactcttcttcccttatcgtccatcatggcacgtactttacctgaacatgcgccggcggcaatgaagtcacctacatgcagggtacctttctgtaccaggatcgtggcaacagggccttttcctttgtcaagctctgcctcgatcacaaggcctcttgccattctcttcggattggctttcagctctgctacctcagcagtcagaaggatcatctccagaagagtctcaattccctctcctgaatgggcggataccggtacaaagatggtgcttccgccccagtcttctgggatcagctcatattcggataattcctgttttactctctcaatatttgcacttggcttatcgatcttgttgatggcaacaatgatctcaacaccggcagccttggcatggttgatagcctccacggtctgaggcataacaccgtcatcggcagctactaccaggatcgcaatatctgtggcattggcaccacgcatacgcatggcagtaaaagcctcatggcccggcgtatccaaaaacgtgatcttctggtcattgatggtgaccacataagcaccgatgtgctgtgtgataccgcctgcttccctgtcagtcacgtgggtatttctgatgcagtccagaagagatgtcttaccgtggtcaacatgacccataacacagactaccggcggtcttgcaaccagtaaagatgcgtcctcgtcgtcctctttcagaagctctgcgatcacatccactttttcttccggttctgcaatgatatcatattccagcgcaatctcctgtgccttctcaaaatcaatttcatggttcactgtaaccatgataccgtccatgaaaagtttcttgacaataacagaaggctgcatcttcatcttctcagccagctcacggatggtcattttttccggaagtgtgatctcttttacaacttccttcttctcttccaccttaggctgtgtattcggtctctgcagagcctttggcagtctctggttcggacgtcttccgccgccctgattcgggcgtttgctgcctgcctggaagtcatccttcttaacgtcctttttcttattctcacggtttaacttgcggctgtctttctccacaaattccagcttgggagcatctgccttgccgcctttatccctgttaaatccgccgcccggacggttatccgtacctctctggcggttgtcgccgaaacggttcggtccgctgccggtccttggacggttatctccgcctctgttgtcgctgttgtagcgcggacggtctcccgtgttggtccttggacggttgtcaccgtttctgttgtcactgttatagcgcggacggtctcctgtgttggtcctcggacggttgtcaccatttctgttgtcgctgttgtaacgcggacggtctcctgtgttggtccttggacggttgtcaccgtttctgttgtcgctattgtaacgcggacggtctcctgtgttggtccttggacggttgtcaccgtttctgttgtcgctgttgtagcgcggacggtctcccgtgttggtccttggacggttgtcaccgtttctgttgtcgctattgtaacgcggacggtctcctgtgttggtccttggacggctgtcaccgtttctgttgtcattgttataacggttctggccgtctccgcttgttctcggacgattatcaccgcttctgttgtcattgttataacggttctgaccgtctccactgcctgttcttggacggctgtcaccatttctgttgtcgttattgtaacgattcggacggtctccattgctgtttgttctcggacggttatctgtcctgttctgagtatttgctgtactttccgttttcattcctccctgtgccggacgattgttccccggctggctgctgctgtgcacactgcctgcttctgcaggacgattctgtggtttttgttttctctcaggcatatgacttgcattctgcggtctgaaaacctggatcagctttttctttggtttttcttctgctgatgctgccggttttgcagaatctgtgctggctgctgccacatttccctttctcaagtttgctcgtatcaagctcacatggtcatcctccaggctgctcatatggctctttacatctatatttttagatttcaaaaaatccataacttccttgttgctcttatctaattctcttgcaatttcatgcactctcagttttgacatatattgccctcctttttatttacccatctgttccagctttttcttcatcgccactgcgaaattatcatccgtcacacccagagacgcgcggtaatcctttccaatggcacctcccaactcctcctttgttcccaccagatatatgggtaccttataataggcacacatatcggagaacttttttttttgaattatctgatgcatcgcctgccacaaggacaaggcgcgcttttcctgccttcactgctttctctgtggcaaactcaccgctcaccactctgccggccttagccgccagtcccagaagggacagttctttactgatgttcaagcttatcaaactccttttccaggctctcatatacagatgccgggatcgctgtctttaaagagcgctccagtcccctgtttttgatggccttctgcaggcactccttgtcaaaacacagatatgcccctctgccgttctttctgcctgtggcatccaggatgatctcatcctccggcgtttttaagacacggagcatctcctttttgttcttcatctcgccgcagccggtacatttccgcataggaactttcctgaccgtacccataatctcacctactcttcttcaccgggaagctggatatctgcaggttcctcataggattccccatcgaagccctcttcctcatagccttcctcttcgtagccctcttcttcaaattcttcctcatagaactcgaaatcaccggactctctggcctgtgtctcactcttgatatcaatcttaaatcctgtcagtctggccgcaagtctggcattctgtccctctttaccgatggcaagggagagctggtaatccggaacaatgaccatagcggtcttctcatccgggtcagccataacagagatgacctttgcagggcttaaagcattctcgatcagaagcgccgggttgtcactccagttgatgatatcgatcttctcgccccttaactcctccacaatggcattgactctggctccgttcatacctacacaggcacccaccggatccacatccgggtcattgctccacacagcgatcttggtacgggaaccggcttctctggcgatactcttgatctccaccgtgccgtcttttacctctgtgacctccgcctcaaagagacgtttcaccagctcaggatgtgtcctggataccaggatcttgggtcctttgggggtatcttttacctccaggatatataatttgatcctctctgtggggcggaacacctctgtcttcacctgttcgttttctgtcagtatggcgtctgccttgcccagattgatgctgtagttcctgcccagacttctctggacaatgcctgtcacaacatctttttcttttccgtaatactggttgaagatcacttttctctcttcttcacggattttctgcagaattacattcttggcattctgggtggcgatccttccgaattcctttgacttgatctccacattcaccacatctcccagatcatactgggaattcatcatcttggcattagccagactgatctccataaccggatctgtcacttcctctaccacagtcttctctgcgtacacgccgaagtcacaggtctcagggttgatattcacatgcacattgtcagctttgccgaaatggttcttgcacgcctggatcagggactgctcaatggcttccaaaagcgtatctttgctgatggatttctctttttccagaatatccagcgcctctaataactctgtattcattttttacatcctcctgaatttcttctatataatatccactgctgttaaaagtcaaatgcctgcctgatcagcgcaatgtcagactttaaaaaggtacgctccccatcctcgttttcaatggtcacgctgtctgtatcataggctttcagtgtgccgtagaactccttttcccggtcaatggcacggtaagttctgatctccagctctttccccatgtttctctcatagtccttctcttttttcaaaggtcttccaaggcccggggaactcacttccataatataagcagtgtcgataaaatcttcttcatccagcttttcagaaaatgctctgctgacaacttcacagtcattcacagtaatgccgccttctttgtcaatgtaggcacgcagataccagttactgccttccttcacatattccatatccacaagttcaaacccattgttctccagtatgggtgttatcaggtcctctgctttctgctcgtatttttctctctgactcattctttcaccttcttccgcattttctatctggtactcgataaagttattgctcaaactttatatttgtaatgtaactgctctaaacacaggcagtacagtcaatacactaacctgaccggacagttactatatggcaactttattgggtacttagtatcccactacataataagagtgggccgcaggcccactcttatgttatcgtgattatcaagttctataccagaataccactaaaacagggaagttgcaagtgtttttgtaactattcccccggcaaggccttttagcaaagcgttttttaccaatacacggtcaaaagtttatcctcatcactgtaccctatgttccactgataagtctcaccttctccgaattgataggcttcccgtacggcccgctcgatcagatcgccgttcaccatagcagccacagcctgctggtaactctccgcatcggcaaacttaaaatcctcccgttcctttccctcccatatggagttcgtcaatatatgatagatttcattctcgtcataataagagtaccaggtaccgttcattttatagtagttatagctgtcgtccacagtttccggcaggggcagaagatcgtccggtgtatgtgtcgcaagaagtgtggaggcatcacagcacagatacgtgtaggatatttcctgcacaaccaccccctcctgtgtttcagaaaaaccggggtttgcccaggtggtatccacatagtagtaatgctcccctattttcaccagattccacgcgtgctcttcattgttgggagccgccgttccggtgaccagcgtacagaaaatccccatctttcccaacagatactgggttgctttggaaaaaccggcgcacaccgtgacctggttcagaaaaacgctctgaatattctgattgttcgggcaggactggtcatacgctatattctggcttaaaaactcgtaaatatacttgatctttccataagtatccgtatccggcggaacctgggagatccactggtctgccgctacctcaatgcctgccttggcggactcgatctctgacttatctatattgtacacaagctgcaggtccacactccccgccgtatctgcatcggcatctccctggaaggtataagactgctggtccagccaaaaaaattctggatggtccacaaacaccatattattgaccaggttaatatcctcctctgtacagtagtcaacggtgaccatgtccttatattccaggatcccgtttaaaagctgtctgtaaagcttctgctgattctctgtcagactctcgtatccatagggtatgtattctccgtttacatactgcagggcatcggcctccgggatttcttccttcttcggctcgaaaacctgatatattttcttctgcaaagaatcagacacactgtccttagcatcggtctctgcctctgtctctatccccctgccgcagccggaaagcagaagggaggccgcaagtaacgcgcacagaaccagactgtatactctctttctcataggcatattctcctagtcaaaccatttcttatgtttaaaatacaaaatctcgatcaccacgatcaggatcactacgccgatgatgacaaaatagctgcccctgtaatggatctcaggcatattgacaaaattcatgccataccagccggtgatcagagtaagaggcatgaaaatagtggtgaccaccgttagaaactgcatgatcttattctgccgttccgcagtcctggcctgatacatctcccggatctggagcgtgtattcccgcaggtttctggtgttatcagcaaggcgctgtatcctctttcccatcacccgaaaaagccggcagtcctcttcccccagaaatcctgtgtagttctcctccagcatttcacagaaatctgcaagctggtcatagtatgtgttcatacgcagaagctccctgcgcacagccagcatcctggccggacaatccttgatctcttcacggaacagaccatcctccatgtctgtcatcttcagctcatacgcctggagaaaacggacatcatcctctatgagacgctccataaattcaaagagaaaatgtgccacatagctctgttcctggaaccggatctcctccatctctttcacgatatgggccacaaatcctgactcatccacaaacagcagcttctctttatccatataatacccgaaagagatgggtttttccagaagtttttctttctgcggcacggaaaaagttcccaccacacaatccttctgcagctctgccttgcagaaatgcacgtgttccaggctccgaagaagcaggcggccgggagcgctgtccccgtattttcttttgtaggattccactgtcagtatctcgatcaggcagtcccctggtgccaggatttctttttccccgagacctgacattttcttattcaaacgatatctcatagcccctccatatccgctctgttcaccgtgactggatcatctataaattatattcttatttttgtaccttttgtgtcgcgttttgccagcttaagtctgttcagagccacatttttttctttatagacagcagtatagtctgtacggctttccagaagataggcatgctccacttcatcatccccggcaaggcggatgccgcgcacgccgatggcagttttctttttatccggaacctcctccttcataaaacgcagaaagaatccgttctttgtctgaagcaccacatattccatggggtctgcgatctgtactaagactaaccggtcaccctccccgagctttgtcgccgctatggtccgctttgacacgtcaaattccgttcctgccacctgcttcaacatgcctgtctttgtggcaaaaaacagcatggaatctttgatccctgacagacttgacacaaacaccatctgttctgcagagctgtcaaaattactcacattgtcaatgggagttcccttatccctgaactttccgaagggcagatccagcactttgatggtatgcattctcccggaatctgtgaacacacagatcttgtctgtattcatacaggagaatatatatttgttctcgctgtctgctgtctccttattccgctcatacgccgccttgtcaatggtcctggcatatccgaaacggtccataaggaaaacaacctccatctcctcgatcttcttttcctcatatacggcttcggcagcattttcaacagatgtgatacgttttctcccgaattctttttttacagctttcaactcatcaatgatgactgctgccatggaatcatagttgttgagaatatcctcatagcgggcaatatttttcagagttgtctcatgctctgccataagcgcctggacctccaggccaatgagtttatagaggcgcatatccagtatggccgtggcctgccgctctgtgaactgcagctttttggcctggcgttcgctggtctttgtcttaaaccggattccctctgtaatgccgcttaccagacaatttttcacctgctcccggttcttgctgcctctgaggatctcaatgataagatcaatgacatcacaggcttttatcaggccttcctggatctcttgtttttcccgctctttcgctagaagagtctgatactttctggtagcaacctcgaactggaagtccacatggtactcaatgacttgtttcaggcttagaatctccggtcttccgtccgcaacggcaagcatgttgactccaaaggtatcctccagccttgtcttcttgtacagcatattggtcaggttctccacatccgcgccctttttcagttccaggacaatgcggatcccttcttttgaggactggttggaaatatccacaatatctgtagtctttttcgtctccacaagagctgccacgtcattcaggaattttccgatgttggctccgatcatggtgtaggggatctctgtgatcaccagaagggttcttccggcttttcctttctccacttccactctgccacggagcttgatcttgccgcttccgctctcatagatggatggcagatcatccttattgaccacgatcccacctgtgggaaagtcagggcctttgatgtatttcatcaggtcttttgtggtgatcgtattgtccttcatataggcaatgacaccgtcaatgacttcattcaaattgtggggcgggatgctggtggccatacctacagcaatgccgtccgcgccgtttaacaagagattcggcaccttgacagggagcactgccggctctttttccgtctcgtcaaagttcgggacaaagtccaccacgttcttgtccagatctgccagatagacctcctgggttattttttcaagccgtgcctctgtgtatctcatggcagcagccccgtcaccctctatggaaccaaagtttccgtgaccgtccaccagggtctggccttttttaaactcctgggccataaccaccagggattcatagatcgagctgtcaccgtggggatggtatttgcccatggtgtctcccacaatacgggcacatttcctgtacggcctgtcatagcggatacccagctcgtacatatcgtaaagagttctccgctgaaccggttttaagccgtcccgcacatccggaagggcgcgggcgacgatgacactcatggcatagtcaatatatgacttctgcatgatctccgaatattctgttctgatgatattatcctgtacgttcgccattttgctcctcctatatgtctaattccgcatcctgggcgtgctcatagatgaatgcttttctcgggggcacctctgttcccataagtacctctgtcacctcggatgccattcgggcatcttctatctccaccagcttcagaagcctggtttccggattcagcgttgtctcccagagctgctgcgcgtccatctcacccagacctttgtaccgctgcagggtaaaggggcctttgtgcctcttccggtaccgctccagggccttatcgtcatagagatattcctcttttcctttagcaggcatagctttatagagaggcggcatggcgatatacacgtgtccctcatagataagctccggcatgaaccggtaaaacagagtcaaaagcagcgtagagatgtgggcaccatccacatccgcatcggccatgatgatgatcttgtcgtagcgcagcttggtgatgtcaaagtcattgccgtacccttctgagaaaccgcagccaaaggcattgatcatggtcttgatctccgcgtttgccagcaccttgtcaatggtggctttctccacgttcaggatctttcctctgatggggagaatggcttgaaaattcctgttcctggctgtctttgcacttccacccgcagaatctccctccacgatgaagatctcacacagggaggggtctctcttttcacagtttgccagcttgccgttggagtcaaaggagtatttctgccttgtcagcaggttggtcttggctttctcctctgtctttctgatcttcgcagacttttcagcacaggagaggatatttttcagtgtatccaggtttctgtccataaagaggacaacctcttcccctgtaactttgcctgtggcctttgccgcatcctgattgtccagctttgtcttggtctgtccctcaaaacgcggggaggggtgcttaatggaaacaactgcggtcataccgtttctgatatccgcacctgtgaagttggggtctttttccttcaaaactcccagttctctggcatagttattcatcacggatgtaaaagtggtcttgaatccggtcaggtgggttcccccttccgcattgtaaatgttgttgcagaatcccagcacattttccctgaattcattgatatactgaaaggcaacctccacggtgatcccctctgattcccctttaaaatagacaggctcatggagtatctcacattttttgttcagatccttgataaaaccaacgataccctccggctcatgaaaggtcatactctccgcctcgtcccctcttttatcctcaaagacaatggtcagttcaggattcagataggctgtttcgtgcagccggctcttgacctctgtggcggagaaacgggtcttctcaaaaatctccgggtccggaagaaagttcaccagtgtccccgttgctctggttctgcccagcttcggcagcaggccatcctccagctcaatagtgggaattccccgctcatagtggtcatgatggatataaccttccctgctgaccttaatgtccagatatgtggaaagggcattgacaacagaggaacccacaccgtgaaggccgccgcttgtcttataggcagaatcatcaaactttccgcctgcgtgcagtgtggtaaatacaagcctctccgccgacattcctttctcatgcatccccaccgggattccccgtccgttatcctccacagtggcggagccgtcccgctccagtgtcacgcggatatctgtgcagaatccggccagatgctcatccaccgcattgtctacaatttcataaatcaaatggttcaaacctttccgggaaacacttccgatatacataccgggccgtttccttacagcctccagcccttccagaactgtaatactgctggcatcataggttgttttctttgccatttctgttcgtcctttctatttctgattcagtatattctcaattgcttttgcaacaccgtcattttcgttggtgtccgtcaccacactgctgatctccttcaccctgtcacaggcattgcccatagccacagagtaaccagcattcaaaagcatctcatagtcattattactgtcacccactgccatgatctcttcctgtctgaccccgatcatatctgccagctttacaatggcattccatttactccatctgccgtgtactacttctatattattagggataacggaaatagggtgtacgcccggaagcagatctatttcctttatcagcttttccttttcttccattttggatactaatatatgtatctttcccacacggatatgatcccctgccagaagcttcctgtaatccgttgtcattttattggtagcaagaagctgatcacagtattcctcaggaaggccgcaccttctgatcacttcctgacccttggcatccatataggcgtcctgacccgcatagatttccacgtaggtatcatattttgctgcaagctcatagatcttcctgacattatccatgtccattccatgaaaatacaggacatcctctgtcctgccgctgctgatcacggagccgttgccgtttatataataggaaatctctttgaagtcctttaaaacaaaccgggcattgcggtaagagcggcctgtagtgggaaccacaaggtatcctcttcttcccgcctcctccactgcttccctggtccgctgcgatatggtgcagtcatcccgaaggagtgtaccgtccagatcgatcgctatcatttttaaatcttttctcatctctgttctcctgttatccttccttattcctttgcccgggttcccctcttacgccccgcgcagtcaaacacatatgcagacaaaagcccgcagcaaatgccaatgacaactcctgccagcacatctgtagggaagtgcacatacaggtacagacgtgaaaaggcgatcagggccgccagtacataggcgcagatgcctgcctttttattttctgtaaaaagtgctgtggccgcagcaaaagaagcctgggtgtggccggaaggaaacgaataatccctgggcacccggatcaaaagctccactgtctcgttgatccagcacggacgctgcctcgccacaagcggctttaaaataatatttccaaacaacgcggaaaatatcagcgctcccagcaccaggacaccgtattttctgtatctctttacacagagcagcaccaggccaagaacgatccagaaccatcctgcattgcccagagatgtgataaatactaaaatcttatccagcagaggggtgtgtatctgctgtaaagcatccaatattgtaaattcccaacccatacgtttttcctttctgtttcggattcgtcctatatcataacttattttggggattttttcaaatctattctgtaaatcggtattttgccctacttctcccctattgatctgtatgtctgttatgatattttgtccgttatattaaatgtagtattggcatttctaatatcaaatacgagtttcttgtccctttccatcaagacaatgtgttccgtctgtatactgccacaaatccataatcatcaaaatccggcatgtacaagctctacaaaaaaggtccatacaatagatataagcacattatgaacctcgtgtcatttcccgtaaaaatacggcagcgaatccgtgctcaatggatttgctgccgtatttttataaataataacttttccatattaaaaataactgtatatgataccatccttttaaaggcaaataccaaaacacctctccaaaagctcctctaattcctcctccccaaactccctgtcctgcactgttttcccgtctctcacctctgtgaatttgttttccataacagatacacttccgttctctgttcttttatttacgtaaagagtccggcagaacactgagttttcatttttggaacaatactcattcataggtatgtaatccaccgcctcctgaggcatggtgtagaactggagcatggactcgatctccccgctgccggtcctcctcttcatggtccaccagggaacctcatccttatacatatagtaccactctcccctgctttccatcactgcgccgtcctgcaccggtacagcaccgggaggcatggggccgccgtagccaacgtcacagaaatactttacgccgtccatctccacaataatccccctgtgaagcaccagcggcacataattcttattcctggtgatccggcacatacatgaactggcatgaaatcccaggtcttttaataaagccgtaaacaaagcattcagttcaaaacagtaaccgcctctgtgcttttccacgactttctcataaatactttcaatatccagcgggatttcttttctaaacagccggatgtccaggttctcaaaaggcacatagagctgatgggcataaaccagctcatccagatattcccttgtaggcgctgtccggcgtttacagtggatccgttccaggtaggcatccgcgtcagggacggacgcatacaatgcttcatacataactattcctccttcagcagcacgccgttatatatgcatacatacataatataagatactttcattatatacagatgtaaatttgtttgtaaagtcaaaaaatactttcgtcattttcatcacaccatatgctacaaaaagtaggaatctattttctccgaatgaaaccctgtgcggatttacgcaaaataaatcctgttatatactgattttataaatttattgcagcataccggtatgtgagcaaaaagtaggagtggacaagtgcgcattttgtcccacaggaagggagaaattcagatgagtagtaaaagtaattccggcactgaaaaatccgagaaaaaagggttgagcaaagcgctgaagctgttctacggggttggtgactgcggctttaccctgatgaccaatgtggagagttattatttcaactttttcctcacgaatctggcacagtttggtcttgccaccgtctcctttatcaccaccaccgcaagcgttattgacgcctgcctctcctggatatacggagcgattttaaacagcataaaaccgaagaaatggggtcgctaccgttcctggctgatccttctgccatggatggtgccgttcctctatgcattccagttcctgaagatcggtgacggcccgctctccatagctatcataatcatagcggctgttgtcagccatattgtatggaacttcccctatgtggccaatgtatccatgatcgctgttgccggcaaaaccccggatgacagggcgcatctggcttccacaagagctgcatgggccaacttttcaaaggtcatcttctcctatgtgggaccgcctctggcagcactctttgcaggtatgatcggagaaaaaagccagtacggggcaactgcttttgtcctcggatgcatcatggcagtgctgtattttacacactttaaaatgttcgacggatacgaggaaatggaagctgccgccgacagctccgctgccaaaaaagacaccagcaagacaggcggcatggatctggtaaaagcgctgctgcagaaccctccgcttctctctctgctgttggcggatttggcaaaatggatgttcaactttgtgtgttccggcgtcgctatctattattttacgtatgtggcacagaatgcaggattgctggccaggtacattcttatctccaatatcctgtgtgtgatcggttcttatcttgcaaaaaacatggccaaaaagatttccaccagaactactaccatcgtcaccttttttgctatggcagtcatcctcattgccgccaacttcacatatgccaatgtgactgtcgtcattatcctcatgtccgcggcacagttcggatatggtatcgcctacgcctgtacacctgctctctacgctgataccatcatctactctgaatggaagaccggaaaaaatgccaccggatggatcagcggccttcagaacgtacctctgaaagtcggcgttatgacaaggggtatcatcatctccgcctgccttgcctttgctgcttttgacccaagtattgacgctgcaatggcatctgtggagctaaaaaagggtatctgcatggcatttatggtcattcccgccctggctctgatcgtggcagccgtacttcttctcttcggcttccgtctgacaaaagaaaaagtggaacagtattccgcagaaatcgccgcaagaagcggtaattaatggaacatataaaacaggaggtctctgatcatgaaatttgacgaaaaagaattggaaatcataggcgaatataatatgcccggcatttacggggcaccggacagcattgtccccaaatataaccgccccattacaccaaaagaaaatatgctccgcatgctggagggaaaaatgccgctctgggttcccaatcagaccctggacaacaatgccatacagccccttgtaatgcccgatgctaaggcccgcaattttgggggtacggactggttcggcatagaatgggaatatgagccgaacacaaaagccgccatggtaaaacccggaacccaaagactgtccgatattacaaaatggagggaagaactggaattccccgacttatccgctatcgactggaaaaaagattatgaggaaaattataaaggcaggatcgcaccggaccgtttttcctactttgtcattgtaaacggattcttcgagagaaccgctgaccttatcagttttgaggatgccttttgtgccctcattgaagaacctgacgagttgaccgctttttatgacaaactggcggactggcatattgaactgatcaagacagctcatgaggtatatcatgcggatatgatcctcttccacgatgacatgggcacacagatcagcactttcttctcgccctccacctatgaggaactgtttgtgcctcaatacaagaaaatcacaaaggctgcccatgacatgggcatgtacatctgcctgcattcctgcggctgtatcaaaacactgatgcccctgatcattgaggcaggatttgatgcctgggagggtcaggacagcgccaatgacaaggctgccatcatgaaagaatacggaaaagatctggcacagtgtactctgtatatcatccccgcagacatgagcgacgaggacgcggttgcggatatacacaaaaaagtagatgaactggctatgacaggccgcttcgcctgccgcttaaaggatgagaaaccggaccgtgctgtgaatctggcagacgaactgtaccgctacagccggatcaaatatgcagaattggagggatcaatatgctgacaccaaaagaaaatttcctggaaaccctgaaaaaagacggaacaccggaccgcctggtcaatcagtaccagccctttgtaccgatcatgaatgaccctctgcagaaattcaccagagggaaccgtgtaagaggcaaaacttctgtggaccggtggggaaccgaaatcctcttcccccaggacgctcccggtccaatgccccatgtgacagagtccaataaggtatgtccggacgtgacacaatggcaggaatccgtgaaggtacctgatctgatcgccaactgcagtgatgggtgggaggaggccctaagttctgccgcccaggtagaccgcagccagaagctagttctgggttttatgggcaccgggatctttgaacagagccattttctcatgggctttgaggatgctcttatgaatctgcttttggagccggaatccatgcaggaactggtggatgccatcgcggaataccgctttcagtacgcaaagcttttggtagacaatctccatccggatattatcctgtcacacgatgactggggttctaaaaccagcctgtttatgcagcctgatatctggagacagttcttcaaagaacactaccgccgcatttacggatatatgcacgaccacggcgttctggtcatgcaccacgcggattctttcctggagcctatcgttgaggatatggtggagatcggtgtggatgtatggcagggtgttctgccggaaaatgatattgtaaagcttcagaaacagcttgatggccgcatgaccctcatgggcggcattgatgccaccatagaccgggaagatgcccaagaagaagaaatccgcgcagacgtgcgcagagcatgcagcacctacggacctgccggccactttatcccctgcatgacttacggccttgcgggaaccatttatcctaagacagatgagatcatagcagatgaaatagaagcctacaacagggagatttatcacatctgaacctctgctgtacaaagcggaagcggaaacatctttttctgcctccgcttctttcttatgcagcctatgtgattttccacgctttgcggctttgcacccttctttcggacatgctatactgatgtcatactgaaacaaaaaggagaatcgggctttgacagaattttctttaacccctgatggaaaaaaccgtctgttccggctgaatatgcagatcctggcagacgtttttacagaacattatcagaatgtcaccttctatgcccaaaatgaccgcccctgtctggaaggcatacggctctataaaaagggaaaaaatccaaatttccggtacgtctacctgatccagggaaaggatgtggatcagtcttttctggaataccgggacattgattttatcactgtgggacgcacagacattgcctgcttccatcaaagctgtgctgtcattgaactgacggacaacgcagattttctggacacctttgaactggtacaggaaacctttgccaaatacaggcagtgggacagacacctgcattatgccctggacagcgaacatcccctggatgaaatgctgctggcaagcctggaaatcttcggcaatcccatgttcatccacgacactgatttttacatactctcctgtcccagatatgtacagggcatgacagtctgggagcgtgattcccggacaggacgtaacatggtccctttaagtctgatccatgatttcaaggcggatacagaatacctggaaacactcagcaaaacgtcgccggatctattctccgccgaacagcggggctatcggatactctacgtgaacctgtggaacaacagccgctatgagggccgcatctgtgtggatgaaatacaaagcgaaatacaggatggcaattatctggctctccaatatctgggccaggccatagaactggccatcaaacataaaagtctgtttcatctgagcatgggcaatgacatggaccgttttttcaatgaatatctggacgggaccatcggtgacacacagcgcatactcaactatctgtatttcctgcactggaagcagaatgaccgctatctctgcctgcgtctggaaaccgaacagagagatatcaatatgctgtccgctgccgccacactggggcatatccaagcccagattccctccggccatgcctttctctacagacagagcatcgccgtggtggtgaacttatcctatgcgcacagcacctcctctgaagtcataagcagcctggctgtcctcatgcgggagggtcttttaaaaatgggcgccagttctgagatccatgacttcatgctggtcccccaggggtatatccaggccagcgcagcacttgatctgggaagaaaaagtgaaagtatgatctggtgttatcgttttaatgactatctgctggaatatcttctgaaaaagggcagagaagaaattccgccccagcttctctgttccgaaaagcttcttcttctgaagaaatacgatgacaagaataagaccgatctgtacaacacagtaaaggtctatctggaactggaacgtaatatcctgcagactgcaaaggagctgtatatccaccgcagtaccctcttctaccgcctggagcgcatccggaaaatagcgggcatagattttgaggacagcagagaacggctggtcctaaggctgtccttttacattctggaacaaaagctggagacctgacgcaaaaaaggaacaggaaacggtccgctataagccgtttcctgttcctttttaatggcagagggttgtctgttccttattttcttccaagaggagcgattttctctctgtatatttttctatagaaataagcactcagtatcacagatgcgatctccgcaatgggaatggaccaccagacggctgacagtcctcccacttttgccagaatggcagcagccggaagaatgatcagaagctgtcttgtcgcagagatgatcaggctgtacacaccgtttcccaaagcctggaacacagaccccactatgatgcagaaacctgcaaacaggaagctgaggcagatgatcctaagcgccggaataccgattgccagcatatccttggacgcattgaacattcccagaagctgtgccggaaagatcatgaacaacgcaagacccagaagcataatgatcactgctgagataatgctgatatggatggtctgggtgatcctcttcttatccctggctccgtagttataggcaacaataggcaccataccattgttcagtccgaagacgggcatgaatataaagctgttgagcttgaaatacacaccgaagaccgctgtggccgtggatgtgaactggatcaggatcttgttcattccaaatgtcatgacagagccaattgcctgcatgataatagacggcacacccacagaatatatcactttgatgatccggcctgatggtctgaaattcctcataccgatatggatatccttattaaacctgatattgaaaaacattgccaggaacattccgcagaactgccccagaacggtagccgcagcagctcccgcaacccccattttcggaaaacccaaaagaccgaagatcaggatagggtcaaaaataatattgatcacagcacccagcccctgggagatcatggtatagaaggtacgtcctgtggactgcagcagcctctcaaacattacctgcatatacacagcaatgcagagagctgaaatgatggtcatgtactggattccgtattcccttatctgtgcatcagcagtctgcatatggaaaaatggttttgccagcagtacaccgagcacagcaaagacaacacagcttacaaaggccagaaatataccgtttttcgccgattcatcagccatcctggcatctttctcaccgagacttctggataataccgcatttacacctacaccggttcccactgctatggaaatcataaggctctgcaccggaaagaccagggaaacggctgtcagtgcgttctcattgatctgtgccacgaaaatactgtccaccacattgtataatgcctgtaccagcatagacaaaatcatgggcagtgacatctgaaacagcagcttcggaacaggtacgacccccattttattttcttgtacgtttgtttgtgtcatataagacttcctttccttcgtgtgtttttattccattatggaacttctagtgtaaaaataatagaaaacacgcaacgcgggttctctgctatcataaataacagaaagcacgcaacgcgggctttctgtcaccataacaaagagtctgcctgggcagactcacattttgcttttaccgtatatagtttaaaggaattaaaaaatattgtcaatccattattctgtctttttctgccgccttcttttcaacagtctgtagaatatggtagaatatggttctcgttttactctctcctaaacttctctcaatcttccctcagccgttcccatacagaatagggtatctttaaattcccccatccgcatcccaaatctatattcggcttattagccccatgaaaatcactaccgccggaaaggcgcagggaaaggcgtctggccagccttatcatagctccctcttccgccggacggtaggttgaataataagcctccagtccgtcaagccctgcctttttcatctctgcagtcatcttttccagatttccatcagaaagcctgcacaataccgggtgggcaaagacagcctttccgccgccctcatgtatcagttgtattccctgaaacggtgtgaccttttcccttgggacataacaggaagcatgatctcccagatacctgtcaaaggcttcttttatagagctgacataccctctttccaaaagaaaacgggcaaaatgcgccctggtccatacactttccggaaattcctccaacattttttcatacgtaacgtccatgccgtgctgtcttaaacgctccatcatctgtaagttccgcgaatccctggactgctgaaaacccagtagctgctcttgaaaacgggcatttttccagtcgatccccaggccaacgatatggacatccctctcccaccaagtggtagaaatctcaatccccggaatcacctccaaagaagtgccttttgcggccctcactgcctcttcaattccatccgttgtatcgtggtctgtaagcgcgactgccctcaacccctttttaactgcatatcccacaatctcactcggcgtaaaagttccatccgacgcattggaatgcacatgtaaatctatgatatcgctcatatcctgtttctcctcttccatcaacgatcaactcatctctcactgcttcagtataacaaaactctttccaatatacaacatcccgcaactgccggaccatcatattatcatttatcccgtacgcagcagcggggttcagatttatcctttttgtggatttttacaggattgacagcagtgtggccggaaggtataatcaatttatctggaaagcaattcttttcttctgcggcaggtctgccgaaaattccagaaagtttaaaattgaatacagacggatataagagcaaacggcaaaaatccggttaattgcaaaataatagttgatatttattgtgtcatacactatattaataatataaaatacagacacttttaacctgacgctttgcctcctgcttcttatccgggaaggaggtctatgaatgaaaccgcactgacagcaatggacgatgagatctatgaagtgctgtctgacaacgaaatttttgcagatttatttaatggttccctgttcggcggcaatcaaatcatccggccggatatgctggcccaggaaaatgagaaaaagattctgcgggcgggaaaagaaggcggcaggcgtatcatactaaggagaatccgggacgtacagaagctgtccctgcttggggagggctgcctggcagttatactagccgcagaggggcagagaactgtgcattatgccatgcccgtccgctgtatgctctacgacggaattgattacacagggcaggtggaacggatcaccaaaaaaaggaaagaggaccttcatgatatgctggatatcccaccggaattagaaccgtggacggaatgcatccaggattaccgtattaatcttgtatgcagccaaacagtgaacagctttcattttaagaccggtcttcgggaggtctttgaactgcttccgcttctgaaagataaagaagggatgaaaaattttctagcggtcaaaaaagaggaatttatgcatttggacgccaaaaaagggtggctggtatcaagatttctaaatgttccccctttgaaagaattaaaagaaaatgaaaaaggagaggtggatatgtgtactgccattgaggaaatgatggaggaaagagaagaacagggcgaaaatcgggtgaatcagttaatcagcgtattactgcagcagtctgaccaggcggaggtttatgaaaaaataaagagaactgtaacagaccgggaataccagaagcagctttttgatcagtttaacctataggaagtgatatgtccggccgcacgatttgccatgcactgatatggagccgagtgctccatatcacaccgcagtccggatttctttattcattttagatccattcaggagtttttgttactgttcatagtatgctaaaagtgtagtttttgtacagtaacacgcttcgcgatgcacacaacatgcaatgaactgcattttggcgctggctaactcgggattttgctacgcaaaacgcctcgggggataatatatgtgaacagtaacgagtttttaacttttttaattttttttttcaaaaaagcttgcattttggaaaaatgtgtagtattataatcaagcgtcatgcgaaacaaacaacacagcagcgcagataacacagtatggttcgttggtcaagcggttaagacgccgccctctcacggcggaaacaggggttcgattcccctacgaactgctcatacagtaagctatagaagcaaagttacaagatacaaataaacacacatggttcgttggtcaagcggttaagacgccgccctctcacggcggaaacaggggttcgattcccctacgaactgctaaaaagatttcagtatttatactggaatctttttttgttgattgttgaaggaccgctgtctaatacgagacttcccgcagcagccttcaaaaccagaaaggaccgttatccaaaggcttctcccttcggacaacagtccttctttctatatctgtttacttttaatcctccggtgcctcggcaggaataaatactctgttgtctacagcactttccggaagttttgcccgctcccatgcctcctcgcagaaataatcctgggaactcagcagtaccttgcctcttttgtctatcttctcatactttccgtcaggctgcagcacatgcgcctttacattgtcagcaagctgcatttccagaatgtgtttgacttcctccttcagcttctcgtcctccacgggaaatacgatttccaccctcttgtcaagatttctgggcatccagtctgcacttcccatgaagatttcctcatgtccgtcgctgtagaagtaaaagatcctgctgtgctccaggaaattacccacaatagagcgcacagtgatattctcgctgatacccgggattcccgtcttcaggcagcagattccgcgcacgatcaggtcaatcttcacccctgccgcactggccgcatacagggcggcaataatatccctgtcgcagagggaattcattttggccactattcttgcctttcggcctttcagggcatattcccgctccatctcgatctggtggataaaacggtcacgcatccagataggcgccacgacaagcttattccaggttcttggctccgagtaaccggagagcatgttaaacaccgctgtggcatcctccccgatcctggcagaacaggtaagaataccgcagtctgtatacagcttggctgtggaatcgttataattgccagttcccagatgtacatatctgcggataccgttctcctccctgcgcaccaccagagtgatcttgctgtgtgtttttaatcccagaagcccgtaaataacatggcatcccgctttctcaagcatttttgcccagacaatattattttcttcgtcaaagcgggccttcagctccaccaaaacagtgacctgcttgccgttctccgctgcctgagccagtgccgcaatgatcggtgaattgccgctgacccggtacagagtctgcttgatagccagcacatccgggtcttttgcagcctggcgcacaaaatccacaactggctgaaatgtcataaacggatggtgcagcagaatatcccctcttctgatctgggtaaaaatatcctcgtctgtcatcatagccggcaccggagccggtgtataaggcttgttcctgtattcatcaaaaccggccattccgtacatcttcataaggaaggtcagatccagcggtccgttgatctggaagatgtcctcctccttgatttcaaactccattgtgaggacttctaaaagtctctcatccatcttgtcttccacttccagacggatcacttcaccccactggcgctttttcaactgtttctggatttctttcaggagatctgccgcttcatcctcgtcaatggtcagatccgcgtttctcatgatccggtacggacaggtgcaggccacctcattgcttaggaacagctttccgatattcctctcgatcacctgctccagtaagatcacaacagtatttccctttttatcctcaggcagcataacaattctgggcagcacagagggcacctggactgtggcgaactcaagctcctcctttccctttttgtccttttttgaaatcagggcaccgatattcagtgtcttgtttctgataaggggaaaaggcctggctgaatccatggccataggcgtcaggaccggatatacgctctcttcaaaatagcggtctacgtacgcctgctgctcctttgtgaggtcctcatgcttttccaccacatgaaggcctaccttcttcagcgcaggcagaagagaacggttgtaggtattatactgtgtctccaccagctcctttgttactgtggacagctcttttaactgttcctttggcgtcatgccggcaatatccggttttgtgtattttgcatgtaccatatcctttaaggatgccacacggatcatgaaaaattcatccagattggaggctgtgatacttaaaaatttcagtctttcaaacaggggaagggttttgtccctggcttcagagagaactctctcattaaattttatccagctcaattccctgttccagtaatattccggtttcatgtaatcttttaaatccatccttatgccccctatcttctcttcttccggcgcagtctcgggcggatactgaacacctcttcaaagaaatctgccttttctgtcagaagtccttcctccagtgtcagatcctcctgcgtatcaatggtcaatattaattctttctcctttactgccgccttaacttcctccactttctgctcatggctgcggtccagggcattggctacccttaatatagcggtcagcttgccgatcagcatgtaagtgtcacggtcaatggcactcttggaatccgcctccccgtaatatttgaaaggctcggaattaaagcgcaccacacttgcaatgacttcccgttccatatgggacaggccgatgatctctgtggacatgatgatcgcataggaacactcagccgcattgctcatgctgatatatttcccgcagtcgtgaaggatgaccgcgatctgcagaagcagcttttcccggcttcccataccgtgcaccttcttcatgctgtcaaagattatgttggcgacctgtgcaaccgcctgggtatggctcttgttgctcatgtagcgcttcgctatatttctggctgataccagtatgtcattttcaaaattatgggtgcttttgatgagcttctgcttctgggcgtagtcataggatacaccgtcatttaactgggttcccggcagccataaagtgtctgctcccatctcatcaataaatactctgcagatgatcagagtcggcactaagatcgtggcaaactccagggatatccccagttccacagcggcctgctccggagatttatggacaatgccctcatacacctgcataaacgcgtcacggctgacagtcctgttttcctccatgctgctttttttcttcaggatcgtttccataaacacatctcccagaagaatgatattatcaatcttcctctctttcagatgcagttttttaaagctcagaatatcattgtgtatcagctcttccaccagatgttcatagtaaacagtctctttctccacagggatcaggcgctcccggatgcgcaggcttcccatcttgaaattctgggtcgtcaccagcgcgtccttgtcaaacagggaaatctgtacatttcctccgccgatctcaatgatagcagttcccttctggatgatctttgtaaatgccgcttccttggccgccagggatttataaccgtaaaacctctgctccgagttgctgaggatttccacattgatgcctgttttctggtatacctggtccaatacgatccagacattcctggcctcctgcagggtactggtggcgcaggcccggtaagcatccacctgatattccttcatgatgcctgcgaaatcccggagtacggcacacagctcctgagtggaatcatacccgatcttgccggtgccgtatgtgtcccgcccgatctccagacggcttctgacctcatcaatctgacggatacctgctttcggcgaaatctcatagatatccatggatacatgataagagccaacatcaattgccgcaaatcttgtaattgccattttctcacctcttccgtaaacggactatatcttatttctgtactcgttggctgaaattccttctatcttcttaaatactctggaaaaatgcgccatatccagaaatcccacttcctctgccacatctccgatgcgcagggacggatctttcaaaagctccttggccttctcgatccgaatggaattgaggatttccgaaaagctcttttccagatgtttgttcaacagcttgctcagatgccactggctgacaaaggtgttctcagccacttcacttaaagaaatctttttattatagttttcctgtatataggccagggcattcttcacaataaagcttccggctgtattttcagactcatcctcctggccggtgatattgctttttttcaggttttccgccatgacctgtacagcttcctctatctcgtccatattggacggttttaaaaggaaacgcgtcacacccagacagatggcctgctgcgcgtagtcaaaatcccggtaccctgtcagaatagaaatctgcatctcaggaaattctactctgagagccgcgatcattttcagaccgtccatgcccggcatggaaatatcggatatcaccatattgggcagctccttccttatgacctccaggccctcctgtccgttgcccgctgtagcagcaatcctgcagccgtatttctcccacggcaccactttggaaagcccctctgcgataattggttcgtcatctacgatcactactttatacatatgtacccccggctcctgttttagttttttcatattgtaacagttcaataccctcacaattacgggctgcatgttacatcgtaactatacagtgccttcaaagtacagacaaaactccgtaccaaaccgcttcggacggctgaatctagtctgacagcggaatgccttcttacggtcagcgcagtgcacgcgcaggcctgctgcatagttacagtttatcacaaattttttcttcttctttcaaatttgcgttaaaattgtgtaaaatatttaccactttttattattataaaacattaacgaaaaaaaggaaagtatctggcctgttttccaccaaatactttccttccgatttttattgttacggtattttccctgcttgagctcctcaggcagacggtactatcatcccttcacagctcccgctgtcatacctttgataatgtacttctgcagacatacatacacaaccagaagcggcacgatgatcaaggttaccactgctgccatcagaccgtagtccgtaccttctctggaggaaatctccatgagcagtcgtgtgatcgcccactggtctttgaaacgaaggaagaaggtctgggagaacaggtcattgtagctccaaaggaaactgaagataccaactgttgcaaaagatggttttgtaaggggcactacgatcttgaagaagatctgcatgggattgcagccttccaggtatgccgactcttccagctctatgggaagactcttgatataccccgtgagtaccaccatggcaaaggccaggttgccggctatctgcggtagtatgagtgacaaaagggatagggaaactttatccgtatttacgatcccccatgcaaattccatacggaatacagggatgatggttgcgaataccgggaacatcatggctgccacaaccagagtgtttaaaagtttctttgttttcaggttatagcgcaccagtgcgtaggaggccattcctgccaggaggataaccacaactgccacgcagcaggaaacaatgatactgtttttatatgcggtaaagatgttcagtctgtcaaatgccgtcttatagttctccatactgaacaggtcaccgatgggcagtgcaaaggagtttgcaattattttctttctgtctttaaatgagtttaagataacccacaaaatcggataaatcgttgtaagtgcccagaatatcaggatgagatatacgccgcacatgcctggtgaaaatttacgctttttcattttctatatctcccttctaataatctttctctttgaaaatgacatttacaacctttgacaggattatacccagaacaacgatcacaattgcgatggttgaactgtaatccgcgtcacttgctacaaatgcgtagtagtacatatacgtaccggtgagccacgtcttgccgtagggcattccgttggggaacatcatccatggcaggtcgaagaccttcagtgctcctgtcacagccagcacacagcaggtgcagatgacattgtggagaagcgggatggagatgaaacgtactctctggaaccttgtggctccgtcaatggatgctgattcatacagttcatccgatatattgttaagtccggtcagtagtatgatgaagtagaatcccacatactgccaggtgactggtatcatcatggtcattatggcatgcgtttcgtccttccagtctgtcaggttcgtctttcctaaaaactccagaagctggttgatcatacctttgtcatacaggaagatcaggttgaacagaagtcctaatgcggttgcggagataacaatggggaagaagtaaacgatacggaagaactttgcccctcttttgatgttatctaccagaagtgcgatgacgatcgcgatccccacctgccccacgatggtcacgattatcatgatcagtgtgtttttcagggcaattctcatattcgggtctgtgaacagacgtgtgtagttcttgtaaaccgggtcattaaaccctttggccggagttgccagtcctttgattttcatgaaactgttgaagatgttctggataaatgggtaatacagatacagaatcaggaacaggaatgcaggcagcaggaaaaaaatggccggcttcttattcttataaatatttgatgtgttattcatagatttcgcctcccagactttcaagcgaacacctgcgtccatttgaaagttacttcacttgcttttctttaagaaggaccggaggattttctcctctccggtccttaaaaaaatacagtttatacgttacagaaactattcttccattgcgtcgataacctgctggatcgcatcactgatctgcatctggccttctacgatctgcggcatattggtgaagataggagctctctgatcttctgtgcacagatcctggcatgcgcctgttgttgcggttacggatttcagcatggtaagagcgtctttttccagtgaattcagtttgctctcatcgatctgcgcgccgtcttttaatgctgttgttgctgttcctgcgtaatcagatacggtttctgtgttgataaaagcttctactaagtctacagctgctttctgtttttccggatcatcccatgcttttctggagatgtaccatcctgatgacaggccgctgatgatatctgttgtctttctctcgttctgtccaggtacaaaagtaactgtgaagttatcaatattatcagaattgtctctgataccgcccattttccaggagccgtctacataaaatgcagctttatcctgcaggaatccctggaatgcttcatcagcttcgcaggtgttggtgttctctgtaaagaaacctttttcatagacatccttgatatcagcgataccggcttcccaggctttgcccactttgtcatccactttttccggaacggctacgtgtgttgccggtgtgtcatgattgtagatagaatattcaaaccaatagtgcggctctttgataagagaagctgcgatcggggtatatcctgcgtctttgatcttctggcaggtctccatgaactgttcccatgtggtatccggtcccgggatctcaacacccgcatcctcgcagactttcttgtttacgtacataccttcccagtatccgtagaagggaactgcatatttcacaccgtcaaccggagatcccgggatcaggtcatcattcatattcgctgcatagtccggatatttttcacggatctcatcaatgggaaccactttatccgcttctacaaacggattagagtcattgccgttgaagtagaacatcacatccggttctgcacctgtctcaaagtctgtgataacacgggctttcatggcttcgtctgcagatgcggaggaatcatttaccttatttcctgtctctttctgccagttctcaatggtttcctggtatttatccacattactctcagttcctgcaaatgttgtggtcacattcaatgtaacctttccctctgcgctgctgtcatcgctgctgtcggatttatccgcggtatcttctttcttggtattgtctccggcgtctgctgctttgttgtcaccgccgcagcctgccagcatagttcctgccattgctccaacaagtaaaactgatacaactttctttttcataactaacttacctccctgtttactgtttgttttgctttgtttttcttgatgacattataataccgcatatattgtaaaaagcgaataactgagactgtgattttttgctttttattgtgctcttagaccaacaaaaatggtcaagcgggcacaaatccggtcatctttttcctggaaaatggacagtccgcagggttctccatacaaaatacccagtctctggttcacatttgctatgcccagattgcctgaggactccttgctggtgtcatagtcaggcgcaagcagcctgtctaccttagccctctcctgcccgctcataatgccgttgttctccgtctccagatagaggtagtcccccttcttatagctccttaacaccactgtgccgctgccgcttcttatgactccgtgctctatggcattctcgatcacaggctgcaggatcagtctggggaccttctcatttaaggtgtcctcccctatctccagatccacggtgagcttatttcccagtctctctttcattatatgaagataagcctccacatactgcagttcttctttcagcggcactacatggcgccgctttctgtccatagcggcgttcatgagcacggacagggattcgatcattttggaaatcttcatattgcctgagagacgggcctcccagttgatgatctccagagtattgttcataaagtgaggattaatgtgggactgcagagccatgatcctggcatccttaagcgccatctcctcctgataaatatggtcaaactgatatttcaggcggctggacatctggttaaaggattccgtcagatagccgaactcctggctccccggctcaaaagtgatctgataccccagattgccctcctggatctctctggccccctccataagctggtctgtgggctgcagaatatgacgccgcaccataaagatcaggatcatcaccagcggaaccagaagcacgatcatcactcccagaatgcgcaggtatgcatacatggaatccattaccacaatcttgggtatccgcacaagagtgtccagacggtagctgttttccttcacgagatttctgatatacaggtaactgccctcccatgtgcttccctgggggtactcatccgggtaaggcccgtcctttttctcctgttctataccctggctgaactccagattcagttcatttaagtagatactcatatcaaagtcttccagaaaatgctgcataccctcgaagcagtacgcgatgttcaggcgcatgacaagcacacccacaggctcaaaggagcggttcacaagattcctgatcatatagacacggccgtcacactccagaaaaccgatgttggtgtcaagggtctccgcgtattttttcactgtctcatggtctttcttccaataggtatctatctgatgataagacccgcccgcactggaattatacacctcaccgtttagcttctccggctcttccagataccagaaaacagtgctggaaaagctggggtccttggtgtatttggtgttcagatatccccgcaccctgccgcttaaccagtaatccttataattgttatttttaaacgcctcgtagacagagcgcagttccccctcataggacgcgtccctggagtcctctatggcctggttcagccgctccacacttgtctgcatattaaaattcacctggtccgtcatattatccacccggtcccccaactggttggacagtatgtaatgcaccatcattcccaccatgagcacaaatggtatcatccagcagcccagggcaatggcgatcactctccactggatggaaattttctttttttctttcatctcttcttcctctctccctgcattctgcggttcctgttctttcaaaccgctctttctatatcataccatgtactttcttttttcgcagaaaaaaatagagggtatactgcaaaattttgtcattctgcagtacgccctcatttatttgtctcatctcctgtaactgctcaataccctgcacgcgcggatatttaaaatccctgtggtcagcccttcaattccagaaattcttcaaaaagctcgcacatgcggacagcctggtaagcctccggcatctcgcagaaaatacgcagaagaggctctgtaccggagaatctggcaatgatccagccgccgtttttaaaatagatcttacagccgtccatataagatacccgctcaataggctcactgatatccggaagtgccttatccaccataagcgtcctctggatctcctcttttctcgcaggcgtgaacttatagtccctctcctccatatagatgcttccgtactcttcctcaatatcccttgcgatctgtgatatcttctttcctgtcacagcgatcatctccaccagaagcatggcggcgtatacgccgtccttgccgttgatatgtccctttacagtgaggccgcctgacgactcaccaccgatgatggcgtctgtctcctccatcttggaggaaatatatttgaagccaacaggaacctcatagcatttctgcccaaagctctcagccacccggtccagcatatgggtggttgccacgttgcggactacaggaccgctccagcccttatattttacaagatagtagtacagcagcactaaaatgtcatttggatgcaggaatttgccggtgtcatcaatgacgccgatacggtcggcatccccgtctgtggccacaccgatatcacagcctctgtccagcacataattctgcagggagcgcagcgtctgggcattcggtgccggcagcttgccgccgaacagtgtgtcatggcgctcatgtatgatctccagctcgcagcgggtgatggagagcagtgtcttcagggatgtctggctcacgccgtacatggggtcaagagccacacgaagccccttgttcttaatagcctccacatccacagccgcgataatattgtccagatattcattgagaggattaaattccacaacctttccctcggcaactgcctgctcataggggatgacagccacaggactacctgctgcagtctcctcctccactttggctatatactgctcgatctcctgtgtctgcacctcattggcatctcttccgcctcttgtgaagaccttgatcccattgtaaatagccgggttatggctggccgtcaccatcatgccgtaaggcagatcatgtgccatcacataatacatgatcagcggggtgggcgaagacctgttgataaaccaggcacggatcccctccgcggccagcacctcacatgcccacataaccgcctcttttgccaggaaacgcctgtcatatccaatacagatatcttccttctctacgccctctgccttcattttcatggcaagggcttttgtcagcttctggatattctcctttgtgaagccgtcacctatgatggctctccaaccgcctgttccaaatttgatcattgctgttctctccttcctgtatgaacccataagttatcccataacgtaaactgtccgctgccttcacaggcccctgaacagttatcccataactactctcactgtatgactgctgcccgcttcacagatggggatcctatctgttttttccccatccagccagatttcctttacacccttttccacatgttccggattctccactgtgatctcaaaggacgcgccgcggaatacccggtgtgccttaaatccgtcccagtctcccgggatgcaggggtctatctccagtccgtccatctgcggacggatgcccagcatgtatctggtggcagcaaagtaagcccagccgccgctgcctgtcataaagggatgtcttgccctgccgtatgcagtgtggtcttttcccataatgaactggcagtaggaataaggctctgcctggcggatctcgatcatatcattctggtaataagggcacagggcattataaaattccatggcccggcttcctctgccaagcatgcattctgcagcccatgcccatggattgggatggctgaacacagagccgttttccttcacacccgggtataccctggtcacaaagccgatgtcgtcatccggcacggtgtaggacgggccgttgagcataataccgtatggtgtaaaaaggttctcataaaccgcatccatggcctttatgcctttgtctttcggagccgctcccgagagcacagcccaggcattggactccagatggactctgccttccctgtccttcccggtaccgatcttccggccgtttttcgtgatgccgcggacataccactcaccatcccaaagctcacggtcgcagacttttttcacgttctccgccatttcggtatatttttccacatcctctttttctcccagatagccggccgcttcaaggaagctctggatcgcccaatagtgcaggaaggataccatggcgctttcaccgcctcccaggttcagacagtcattccagtcagcgcgcagacccttgcacacgccgtcggctcccacctgtctggcggaaaagtccaggatccgtttcatgtggtcatagacagttccctcatctttgtcagcataaggcaccacctgttgaagcagatcaaattcccctgtctcttttacatactccacaatggagctgaccagccacagcgcgtcatcagagcaggtgtcctccaggccgtggagcatctggtccctgctgggtgtgggcaccactgtgggggatttaaagggcttcacttccgtatccgggtcaaaccattcaggctggaacaggtgcaggccgtacccctcagacacctggcccctcagaagctctatgatcctctgacggcacttttccgggtttgagtggggaacggtcatggcatcctgcgccgtgtctctgtagcccaggcccgtacgtcctcccacctcgataaaggaagcaaaacgtgagaacatgacattgatctccgcctggtaaagtgtccatgtattgatcagcgtattcattccctcattgggagtctggatctgcagtttatcaaatttgctgtcccagtagtttttcagttcctcataggctgcatccacatttgcaaaattgctgtatttttccctgtagggataagcggctttcctgttcccctcacccagcataaataccaggcgcacttcctggcccggagccagagtgagctttttctgcagagcaccgcagtggttgtttcctttctcaaagccgccgtttaagacacctttttccacgcctatgggatttgtctctgtgcggtagggaccgatgaactcatctctcaggcactcaaagccgtccggctcaaagctggctgtaaaccactggaaaccaaactcttcataaaagagatcatgctctataataccgtcctcacaggaagaacctgcggcatacatgctcatctggaaattcttgttatccatctcgatctggtggaaagaaaattccaggtaagaatatatactgaggcttctcgtgcgtccgctgtcatttttgatctttacatcccaaagctccaccgggtcatccttggggatacacattttctgggatgccttgatgccgctgtactcacattcatatacagaataagacatgccgtggcggcaggtatattttgcttcttccagggatttgcccacaggctgccaggatacgctccagtaatccccgtcctcgtcatcccgaatatacacataatgccccggacggtccataggaaccccattggcccggaaacgggtgatgcggtggtactccggtgatttgtagaaaatatatccccctgcggtatggttcaaaaccgcacacatatctttgactcccaggtaattggtccaggacgtaggtaaatccaccctgtcaatcacgtactctctcttttcattgtcaaaatgtccgtatttcatgttacgaaaccctcctgaatctcctattaagaataccggcagcagaacccctctgtgcggtcctgccccttctgtgacgagaggggcctgcaccggcagacccctcttcgtcttcctggctctattatagaaaactttccgtttcagtaacatagttcaggatgtcaatatttgttttttcttgtgaagacacgctttcgtcttccagatattttttaagtgcctccgcccgtctttttgccgtctcatatccctggcggtaaagtgcttccagttttttcccgtctttttctaagcgcccgatctccacaggggccgggggctggatcaggaaaacttttccctctttttcctcccgatacaggtggtccagggtttcgttataatccaggtgtctgttttccatccgctccaccagctttggaaactgcctgccatagcggagacgcatgaggggcatcatctggtttttctgtttccgatactccctgccccttgtgaggatcaccacatttttttcatttcccaggctttcggatctgcggatggggatggaatcggtgataccgccgtccagatatggtttcttccgtatccacagagttctggacataagaggcagggaactggacgcccggatataacagatctcccggcgaaggtcccggatgcgcttatactctgcctgtccggtctcacagttggtcacaaccgcataaaatttggtggggttgtccaaaaaggctttatgatcataggggtccagctcatccggaatggtcttataaagcatctccgccccaaaatagtcacctgttttgaaaaagctgcccattccgcagtatctcggatcatccagatacccggtaaccgtccggtatccccttctgtgctgctttgataaatagctgcaggccagacaggaaccggcggaaactcctatgcaggtgtcaaactgaatatcctcctccagaaaaaaatccagaacacctgcggtaaacaccccgcgcatgccgccgccctctaaaaccaggcctgctttccttacattttgtgtcatctcaccgtcatctctcttccgtctcttctttgctttcatatattaagaattccctggcaggtgccccgcagaccggacagcgatcaggccggctctccatcaggcatccgcagaccggacacacataaaacagattcttatgaaatccttcacagtctgctgcctccttcagaagccttgcgtgggctttctccgcagacccagcatcccggtaagcctgccttgtcagcagaagatcatgctcctgagcgtagtccgcaaccatgggatataaacgctcatactcaaattcttcccccggcacataggtgccaacagattcatgaaacgctttgggcttatctaaaatggcataaaagctcttggcatgccgatactccgactctgccagcgcagaaaacagattggcgatcttttcgtatcctctcttcttcgcccgctctgcaaaggtctgatatctgagaaacgcatacagctcccctttgactgtggcctcaagctgttcccttgtgatcttgtcctctcgttccctctggtatggcgcatccccaaggttctcaaacctgtggcacagcctgccgttttcccaggtaaatcggacaatatgatgttccacatctgatgctttgatgttctcggatacatcttctatgacagcgccgcctcctcctgtacacacaaaggggatttgatccacctcatcctcaaaacaggaatgcacatggccgcacacaaaatatttgatcttctctttatatggaaggtacactttcctgaggcgttcaaattcttcctgaggcactgaatttcccgtaaaatgatttggcagaggaatgtgaaaggcgatcactacattttcgcactcctccatggcaagtacctgttccagtaatgcaagccctgtgtcagaaaatttccggaaagcattgtccaccactacaatggtaaaggtctccgcaatgactgcatagtcatgcaggccgaagaacgcctcatagtcccctgtgtcgtgattgccccgaagcacaaaaacatctttttccgtcacggattctgtgagtgtacatatatttctgtagtgccgctcatctcccacaggaaccatatcccctgctatgaggatcatgtcctcctctgacgccttttccagcgcgcccgcataggttttcatcataacggtccccagtccttcacagccgggatctccgatcacagcaaaggatgtgcagccggggcggcggacaataggctctataattttctgaatcctacgtttcttcatgttaatacctcctcaatagtatcattttactttattttttctgaactggcaacccgaatcgtgcgcacagccttcttcccctcctgctccatgtactcctcaagtgaggaggtatcctgtttcagcaggaaaagaatgctctggagatacattttgttatagctgtcatttaagtccagtcccagcatctcatggatacgccttaccctgtatttcagggtgctgatatgtatgccaagctgtgatgcagtccggctcatgaccatgaaattgtcaaacaacgcctccagggtctcatagtagctggtgtggtggacatagtcatggtgaagcaggtccttaaggcctccaaagagaaggacattgaccggaagggacttccacccctcatagatgatataatccagggcaaagtcctgaaaaaggcaggctttccttgtatagtccagtttattaccgatgcgaatggctgcttttgcctgaatatagtaatcgggataatctaaaaagctgcgaaaaggcgtactcacccctgcgatcaggggggaatcctttaaaacctgctccagtctgtctgcaatctcctccacaccgcccgatatcttcaagaggttacagagaaagaaaatctccgtctttgtcttcaccatcaggctgctgctctcaaacaacgtatcagccggtatctctctctggctgactctgctgaaaaaagctgatttcaaaacaatacagacatagctccccttcgcctcccagccaagggttccaagcccgcgctccaggctcttgggcatctgcggcaggctctttccccgttctgcctgctctgccaaaatcttctgcatccgctccattccctgacacctgtttataaaatttacgcggtacatacatttcagatatctgccgatataacagagcaaaaccctgtcccgctctgccagaggtgttgtaacagagagcagaaaaattcccattaaaatgctgccggattcccggaccggtactgccaggaagggaatcccctcctctgtggccgataccgcgccttcctcctgcatccacacgctccgaaacgcgcgctccagagcgggccgcagaaaatccgtatccccgtccctgcattcgcagggtatcctgcaggtatcctcattttgggacaaagccagaatttccatatgcccgccggctacaatgatgggattggaaaatacagataaaagcaccggagcaagggcggaaaaatccttaccctccctgcacagtcggttcatctcctcctcaaatttcctgtatttttcaaatatcttcaatatcatggacaatatcatctgaggcgtcagatacggcctgacccagaggatatccaggccctccctctccaggcattcccgggatggcatcccgatactcaccacagtaagcgccggatgctttttcggtatccgctccaaatccccggcatacatgatatatacataatagggtctgaatggggacccctctctccagatcagtgcattggtcaggggaagctccatggaatccgatctcagggaactcccctcaaggccttttaagtctccggcaagtatatatccgttcagtttcacaatatcacctcctgctgctctgcaagctccggataacgtttcaatatacggaatatcagcatcagataaagcctctccttttgatcgtccacatccatgtccaaaagctcccggatcttcttcattctggatttaaaagtgtttctgtgaatgtacagatcatcaatggccttggctgtgtgggaatcaaattgtatataattcagcaaggtcttgtaatagctggtttcatgtaccttatcataacggataagctccagaagagtacctggtatcagagtcctcacaggaagcgtatcggcgccccggttcaaaacataatgaagggcataatcctcgaatttaaacaaccactgggtactgctgcactcctttcccgactgaagggcagcctctgcctgcagataatagtccggaaacagaaaaaaatcagtaaattccgtacttatccctgatttaaacaggttatccctgacgatataagccagcctccggcactcctcatccctgccctccggcaccattccgagattgcacagaagcagcagcctgtctccgtattccagagagagataaccgtgaaactgatggtcaaaaagcacgctctcataggcggctgaatgcagttcctgccccgcttctgtcagctccatgcagacgcagaaaaaggaaccgttccgcttccatcctgccagccgcatagccatgagaagcttatcgctgtcaaaggaggacgggctgcgcagatattccagggcataattcttaaatgcatccagagcattgaattttggcccggagtggcgcaccgccagtgcccgaaccgcctcagtaaacacagacagcagtgccaaatggccgtccgtcagactctcatttactccgtctatgacgatcctgccccagtattcctgattctcgtcaaagatattactgtagatgcttatatactcttcctcttcgttggtccaatactgaggcgtggtaaattcaagggtcgtcagataatccgaacggaaaaacaattcatctgtaatatttcggtccagataatccgtcccttcctgtaaaaggctgtagggaaatctggcacctcccgcctccgcacatccgatcagctcatattctctgttatgtaccatgacaggggcattaaaaatgggcagactgatacggcagagggcttcaatactccgctcccctgccaggacggaggaaagcccctgctcccatctgtcatatttctcaaaaatctcttccagccgggtcagcactgcatcagcggccagactgccgtccatacagatccaggaacagccctctaaggatccctccgtctcctcctgcccctccaggcagataaacgcgtttccgggttccgcttccggtatctctgccgcctggcccatggtctccaccagataaagcgtatcttcacgcaggacacattccggctgataaacggtataaaaggacagtcttctctccagaaaatccccttcctgcctgaaggcagacacatgttccagttcattcatcagaatctgaatatttaattccatcctgcacctcccaaattttctaacacattcccgttctgcccattgcctatagctccattataaatcctgggaattccttttaccagaagatcttcttctgttactattcagccttcttctcccttttgacgtttttttcctttacatttcacacaaacagacgaataaaattaaatatttctattttttcaagagttttcaacggaaaacctgcgaaattacaggaattttaaggatggtctgccgggcggtatccgatataataaaagctataagatccggatcgtaaatattttatggaggtgtaacatgaacaaagaaatgaccaagggacgggctcttctctttctaatctccctgttcctgacaaacgtggcagtcatggcggacatggtcatcatacctgccggcaacggcctgtatgagacattccaaaatgatgctgccgtcaacttcattttgtcaggaccatcctttatcatgctgttttcagctatgctctgcgggaagctgatgcagtatctgagcaagaaaaaaatcctggtgggcgcaatggtactttttgccgtatctgccatattaggcggagctgtggagaatgtctattatgtactcgccatgcgtgtcctggtaggtatctccatgggatttgtcaatgccgccgccatggcgcttattgctgaagtctatgtggatgaggacaaacgcggaaccatcatgggcatcttcaatgccaccatggccggaacgggcgcagtgatcagcctgatcgccggggtatttgccgtccgctcctggaatgaggttttcaaggtatactggatcgcagttcctgtcattgttatgatgctcttctttatcccaatgactcccccggagggtgaccagcaggcaggggaagaagaggggtcccatacaggaagtccttatctgatgcgccaggttatgctcatggtatcctgttttgcctataatctggtttacgctgtcatctattaccaggtttctgtactggtggcggaacagggctacgggaatgaaagtatcgcggcactgctctccacactggggactgtgggaagctgtattctctgcatcctcttcggcactctgtactcaaagctgaaaagagcaaccatcatcttcggatatgccgggctgtgtatttcctatctgatgctctttctggcctccagtccggtcatggccggcattgcctgtacgctgtgcggcgcttcctatggatatgggttctcctatttcttcctgaggtgcaccgtggtggttccaaaagaaaaggtatcctcttccatctccatgaccacagctatcggaggatttggaatgttcctttccacttatgcctgtaccatgctccagaagatcctgggcaccacaggaatcgtgtcactccttccggtagctattgctgtttccggaatcggagctgttttgtctgttatctgtactgtcatggataagaaaaatccaagtgatctgtccatgcaggaaaattaaacgattaatataaaatggaggtttttattatgctgacaaaaagacaaaatttactggaaacgatccgcggaggacatcctgaccgttttgtgaaccaatatgaatttctgcaccttgtttacggcaatcccttctttgatctgcataacggtcctgtactggaagaaggtgttataaacgccgtaaacggctggggcattacattttcctggcccaaaggcacgcccggtgatttcccggtccacgatgacgagcacctggtactcaaagatgtgacacgctggagagaattcgttcatgctccaagccttgactatccggattccgaatgggagccttatataaaagaagtggaatctgtggacagaaatgaatattttgtatctgctgtaatgtatccgggactttttgaacagtgccatcatctgatggatattccccagactatgatgaactttatcgaagagccggaagccatgcacgagctgatcgactatctcacggactgggagctggagtacgcggataaggtctgcaaatatctgaaaccggacgccctcttccaccatgatgactggggaacacagacctccaccttcatctccccggctatgtttgaagagttcttcctgccggcctataagaagatttacaagagataccgtgacaacggcgtggagcttattgtgcaccactccgattcctacgcggcaacactggtaccttatatgatagagatggggattgatatctggcagggcgttatgactaccaacaatataccggaactgatcaaaaaatacggcggacagatatccttcatgggcggtatcgacagcgccaaagtggatttcccaggctggtccagagatgtcatcaagaaagaagtacgccgtgcctgcgatgaaaacggcaaactctatttcatcccctgtgcctctcaggggcttgatatcagtacattcccgggagtctatgaaactctcagtgaagaaatcgcagcttacagcaaagaagtcttttagcgtgtgtctgccacaccccggaaaccgccctgccttcctactcctctggaaggcagggcgattccggtataattttgtaaagtttttgtagcaaattgagcaaaaacacttgcatggtgtaaaataatatggtaatattaatttcggttcgtgagaacgagccgctgtggcggaattggcagacgcacttgactcaaaatcaagcgggtaacaccgtgccggttcgagtccggccagcggcagcatgcgaaaactctttggatgagaattcaaagagttttttctttttttatccttagccttttttctgcatgccgcctggctgtactggaaatatcggcagtatggcttctgctgacgatactttactgttgaaatccaagtgcgtatagatatttgatgtagttgagatatcactgtggcccatccactcctgtatctgttttagactcacgccgttggcaaaaagcagagtcgcacagctatgcctcagatcatggaaacgtatcttcctcaggccattcttcttcagcagtatagaaaaatgctgtgtcagatatcccggtttcatccgctctcccatttcattcacataaataaagtccagatattcctgacagtaacagtcaccgcacagccttcgattttctttctgttgaaggtacagcctgatgagcagatcctcaaatggctttactaacggcaatgtcctgcagctgctcttcgattttgtacgttctttctctatacgttttagttttccctcaaagttcacctctgtaacagtatattttatcgtgatcgtcttttgctcaaaatctatggcatcccatttcagtcctacgatctcacttcttcgcagtccataaaaggaagccagcaagatcccaagctccaacgggtcccctctggaaacctcaaaaagccggctcaactcatctgccttataatacgatgctgcataattcagttttcttggtctttcgatacagtccgctggattctacttgatgagaccgatcttcacagcatactttaacgctttcctgatatttgcatggcggtggatgactgtatttgctgataatcccagatccagctcatgctgataatactcctgtatatatttaggattctcttccatatcggccagagtatattgtttctccttaaaatatggtacgatacgccttttgaccattatagagtagctggcaaatgtagtctcttccacacactgcttcatcatttccaaccattccagcataaaatctgtgaacaagatagagacttctcttgtcgccggattgatgttctttgcaggattactttcgatcagtgtcagttctaacgcgtgatcaagtgcctgcagtatgatctcatgaagctgcaggatgcctgcctgtgttgtgtggttgttattcttctcataatgataataggcttctatatgactggtacgtatatcacaaatacgaacctgttgtctttcaaaatacggaaatagaaagctttttatgttataagaatagactgcatatgtctccggctcaatatccttcacattttccttcagccactttagcaagaattcatgaaattgtaagttcttgtccgtcatggcatctgaaggattgaaattttttcttgtttccagcagcatcaattctgcacgtttccttttgtcgtaagccccgtagaaatagacttggtgcgtcttttccctgtatgatctttataattcgtcctgttggctccattccgggaatcacagcggttttaccattcttttcttgtatttcctcgattcatgccttaaatgtaaggaaccctgcttctgtattgctgaaaaccaaaggttttctggtaaactcgaaatttctccaatcaaatgctctcgcatagtgcgtttcgcttccgacatcaataccaacaatcaaagttttttcagttatggatgcaatttttgcgttctgtgtgttataatttatttcaaatacctctctgttcaataagatttttactaaccgctcaaagtcagtaatcttattttactctgaggtatttttttctcaaccttctttcttggaattccctatatttgaattatacaggaagctcctatctgtctaagaactctttattataacataaaccctgccataatggcagtgtcaatcttttttttcttcgtttttctacttttttatatctaactcaagatttcctaaaatctgtatttggtttccacataccactcttggataacaccacttctccctaagaaatccattgcaatcaaatttcatcctatcaatatactcgaaaagatttttatagtacgttccaagttcctcccactttgtatcaaatgctactgatacgcaggtgcattctttctctgttttcacaaatacatgtgttatcttttgaccaacataaaatctgtcttctttaaaatcaactatacattctctccttggttgatactctacatacaaataccggaaatctccctttctcgctgcctcaaccggaacaattccatataataccggatagtcctctccaaaatattttgctatataagacatcactttacgaaaatattgctctctttcggtctccgtatctatctttatctcaaatactacaacaggccgttcctgcaaggtcaaaatctttaattcaccgtcacgcatattattctgcttcatatcctcgaccatgcgattcagatatctccgtttttcctcttcttctttaatgtgctgattaatcttttgctcttgttgacgcaaaatctgaagaatatcatcttttgatcctgtccattgtctctcgctgaattgttcaataatattatcaatcggtattcccagattacgaaaacagcgaatcatgtccaacaccagtatttgattttctgaatagtatcgatatccattgggggcaatatggtgaggcctaagtacccctttttcttcataatatctaagcgtacggttcgagatatgaaacatttttgccaattgtccaattgtcaaataattatcctttttatcatccataatactctcttttcggaaccccacctctcgccatatattgctctgcgtaaaatcttcatcattttattactatatctgatatttttagacagtggaagctcctccggggatattttccagaaaaattttactgcttaaaaaagcgtatattatggattaatctgcttaaacgaaaccttatccgggggattttccaactccccacaccggttttagatcaaacctgaaaacggtcataattttcaaaacaatcaaggcaaagcaattttccttcacttaaccgtaccatattttctgaagcagtctctccacagcagctgcattttacagactgaaagattctggcctgttccggaagagtaatcgtagtcttcttcacatcaaacatggcttctggttccaggttctgataatagttaaaagattcttcacgtgtcattccttcaggtcttggtttcaaaaccagtcggacggattttccatttattctgttgtagaaagaaaatgcctgctttcctctcatatgaaacaacagatttcccttaccgacactgcatcccatgattgcttgtatggcatccacaccgcaggcatcattttccgatatacaaactacctgctcatcacttgaaatacaactatcattgtactctgtttcttccgtctttaaatccaatagctttattgcataaagagctgctttataacctattgtaagccctccgcattcatgtccatgaaatgctttacacttatcccaaagttttgtgatcatattctactactccttaaacatgccaatacatagttataatgaatttataaccattctccttaaagttctccgacttttttgcaggatctatatccgaaaattgagccggatataaaatgcttcatgcataataggtatatgccaaagttgtctccagattagacgcactggagcggaaggatatcataccctaccatttcttttctcttaatttaggcatagacaaagtgcccgtttccacagtctttcatctccccattatcatgcagtgctgtttccctatattccagcagttttttatcccgttcaaaggccggatccggaactggtatcgctgacagcaaagattttgtgtaggcatgcagcggatgatcaaaaatatcttctgttctgcccatctccacgattcttccttgatacataaccgcaatacgatctgagatatatctcaccacagataaatcatgggcaataaataaaaaggtacttcggtgctcttcttttaaatgataaaacagattaataatttgcgcctgaatggaaatatctaaggatgcgataggctcatccgctaaaatcaaatccggttttacagagatacttctggcaatggccactctctgtctttggccgcctgataactcattcggatatttgtcgcagtatgagacatccaagcctacataggaaagcagttgtcccacttcctcatgaatctgtttctttgtcttccaaacatggcttacaactgccggctctgctatgatctcctctgctgtcatgcgtggattcaaggctgcagcagagtcctggaaaatgatctgcatattcttctgtacatcttttttatcaacggcagatatctttctgtctgatatttttcgatttttaaaccatacctcaccttctgtcggcggatatacccccataatggtcctggctattgtggattttccggaacctgattcccctacaattccaaatacttcacccttttttatattgaaactaattccgtctactgctttgaccgtgtagtcttttctcaaatgaaaatgttgttttagatttttcacttccagaattgtattatctttcatttgctgctctctcttccttgaaaatctgtggcggctggacatttggcgcccttttatcaagaagccaggtagctgcgctatgagttggagatacctgaaacataggaggcatctcttcataatctatggccattgcatattcattcctcacagcaaatgcatctcctttgggcgggttcaaaagcattggcggcattccagggatacatttcagcccttctcctttttttgccaaagacggcaaagcagacaacaagccccatgtataaggatgccgcgggtcataaaagatttcttccgccctgcctacttcaaccagttttccggcatacataactgcaacacggtcagcaatctttgccacaacaccaagatcgtgagaaatgaacacaattgataatcccagtttatgctttaatttaagcaataaatcaagaatttttgcctgtactgtaacatctaatgcagtggtcggttcatcggcaaataacagtcttggcttcagagccagtgcgatggcaagcacacacctctgccgcatacctcctgaaaaataatggggctggagcatatagcgatgctcagcatcttcaattcctaccagatcaagcatttcaacagccctttttttagcctcttccctgcttacgcgttcatgcttcaaaacggcttccataatctgctttcctacgggcattgttggatttagagtagtcatagggtcctgaaacaccatggatagcgtagttccccttagattacgcatatccttttctttataatccgtaatatccgttccgtctataagaatctttccactcttaattcttgaattaccgggcagaagttttagaacagactgactcatcactgtctttccgcatccagattcacctaccagcgcaagaatctctccttcctgaaccgtaagtgaaacatctctgactgcctgtacttctccttttggtgtgtcaaaacttactgacaaatgttcaagctccaacaatgctctcatagcttatatcccctatctgctgattgtccaatcctcaatattccacataacacctactgcatgatgtccaagaatccttgtattatccagaccctctacaccctttatagacacataattaccatccaagtaagcgatcaggatctgtcccggattttcagcataagcaacctcgaagtcctgatatgcttttttgcgttcttcgggatctttagcatgacgtcctgcttttaataactcatcgactttttcattggaatatgccattgtattttcactagcatctgtcacaaattgtttgtacagtccatccgggtcaaactgggatgcaaaccctgctaagaagccattgtatcctgattcccagtcaaactttgtcactagttccacttttaattctacccctgcttttttcagctgctgtgaaacaatgttttcaatatctacacgctcttcctcataatcacgtacctggatactaaaggagaatttctgtccatttctctcgtaaattccgtcgtctccctttttccaacctaatttgtccatctcctccgcaaacttatctaaatcatagctatagatatccgctgctttgtttcccccataaggattgatctgtatcggactgtaggcgacaaaaccatggccgttcaatacgctgtccacaatagcctgtttatctattgcatagttcaggaccccgatggaatcaccattttctttccagaaatcggtacggaaatcacaggatacggaacgataatctgcagtcttaaaatcataatttgtgtaatcatcatttcctctaaattcatctgcatattttgcatttaaccaggccagatcagcttctccggactgcagcatggtggcttttgtgctttctacagatactgttttataaactacacggtcaatattggggactttatcataataatcttcatttttttccaaagtaatacttccgcctgctgtatcccatgaaacaaatttatacctacccgttcctactggtttctggttaaatgctgttgtattgatatcctctccttccagcagatgttttggaaggatacccatagtaaagttgtccagcatagctgcgttatattgtcccattgtaatggaaaccgtatagtcatctgcagcttttacctctttgatatcctcataattgctggttatgcttgcggtcagattttcatcttttgtcagtaaatcgtatgtgaagacaacgtcatctgcagtaaaatcttttccatcgtgccatttcacgccttctcttaagtgaaatgtgtatgtcatgcttccttcatcatattcatagctttctgccaagtcttccactggtgcaccatttgcgtcgtatttcataagacctgagaagatgatacttggaagttcatcatgattattcaaaagtggattgatcgtatcctctgattcacctgcataaaccagtgtgtttgacaaatccgattcatcttttgcagagtctgcatctttctgtgtctcctgagcagttcctgctgtctctgtctccttttgttctcctacctgggaatttccacatcccgccagcatggtacacaccatagatgctgccagtaataaacttgctgcttttcttttcattttgttcattctccttataaattacttggttttctatttgtttccttacggaaatagttgccgatatttgtaatacagatcaatgtggtgatcaaaaacaagccgggtatgatgatgacccaccatgtattcagaagcagcgctttattggccaatgaaagcatactgccccaggaaaccacatctaccggaagccctaagcccagaaagctcagtgtagattccatggacatgctggtactgatactggacactactacaaacatgatcgctgatacaaaattgggaaccagatgttttttcatcacatgcccaaaactgcttcccatacatctggcagccagtacatagtcactggaccgtatctgccttacctcactcctgacaatacgggcaagtccgaaccatcctgtcacccctattaccagagatattttaacaatattctgttctcctgttacagatacaagcaggagtaccagcagcaaagacgggatactgttcaaaagctctgcggcgcgcatcattacagcatctatgcctgcactgcacataccgctgacgcagccatatgtgatacctatgacagtaataatgactgtacttaaaaggccaatcaatatggaggcccgtccgccataccagatcatggaatatatatcccgcccaagagaatccgttccaaaataaaactcctttcccggaacctggttcaaattttgcagataaaaatcactggggtcatggttgtacaattgttccgcaaacaaacatccccccacaatgacgactaaaagtatgatagagataattggttttccttttatccactgtcgaaatgtctgttttttaatctccggtacgtgctgtctgtaatcagcacctacgatccggaagccatcactccttaattccatgatgctacctccgctcctttcattctcgggtcaatcacctcattgataaattgtgctatgatactactggcaatgaccaggacacctgtgatcagtaccagaagcatgagaagattataatcatgatattttgcactttccacagagagtgccccaagccccgggtaattgaacacggcctctgcaatataagtaccgctcaatacatgaggaatggaaatagccatgatgctgacaatagtgggggccacattcctaagacaatgaaaccataaaatctgatttttccttattcctttcatccgtgccagaaggacataatccttgcgcacttcatccaggagcttgttcctgatcatataagcgtaataccacaggtggctgagaatcatgactacaagcggaagtatcatatgacggatacgattaccgatatcatttgcttttccaatatcatatgcaccgctgctgggcaggacatgaagattaatgctgaaaatcaataccagtacaacgccaagccaaaaaggcggaatataatatgccgcggttcctactttacagataacacgatctatccaagtatcttcaaaccgagcgcagaacacagccagtaaaattgccagaagaaacacaagtatgtatgctgttccgcctaaaataagtgtattgccgataagtggctgtacgactgacatggcaggcgtcttgtattttaacgacaatccgaaatctccatgaaatacattctgcagccatcgtacatactgcacatgaatagggccatccaatcccaggcgcattcttgccgcatcttgttcctccaccgtcatggattccaccgcatcaccataaaaagactgcagcggatctcccggcgctaaacgtgcaaaataaaaaacaataacggacaacaaaaacattgcgccaacaaatcccagcagcctcttcccgattttaatcaggaattgctttttctttttcattttgtatcccttcttttatcctttattacagaggtttttataagactatatcactcagtagattcagtacctttaaagtataaacttcaattttatattctggaagcctcccccgtggttatatttttttttgcttttttcttccttttttaccatgatcatgaataaagctaaccctatccccgggttaaataaatatattttaatcatattttgtataaaaataggatgttagatttttgttattaaacagtgaactagtgctccatccagtcagaaaccatagtagtagtgctgaatattttatcagcctgcaaggcggaggagggaagcggagtggttcctccgctgactgacgacaacgcggcagatgtcaaaataggcagtgctgatactatggttcttggccggatggagcactaagatgttgccaaatacatacaacaccctggctctttccagtaaaatcatgggactgtggataaatctgcggaaactcaagtctgaaaatgattgcattgttgttctgcagtagtataattgtataaaaacttgaaagacagggggtactgatgaaaaagtccaattatgatataatgagggaccaggcagaagtcgatttcctgaactatgatcaggaaaagacaattgccaaatttggtttggattttaatgacgattatatttatgttaagtttatcagcagactatatcagattaaccgccgcagcggcaaggtgcagtggcttgatgggcagaatcagcttatatatgccggttacaatgaagtaatggccatctttgatgtattgctggtcaaaagaatattgctgtctttcgggagaatacaggcagattaatgatgttcgcggtgcgatgaagtcagccactttgggcagagatttttttgctgactatgcggaaacatttgcacataaactgtgcgaattgagtcgtgcctgtgatgcacttggaggaattcaggaaaaagtaggtgacgtagcgtatcgaataaatctgtttgattttttgccattcttatttcaatattgggattccgatgaggagtttccggctgcgctgaagattatgtgggataaaaacattatatcttacatgcattacgaaacaacatattttgcggtaacgcatcttttggatcgaataaaggagagtttttattcacagactactacattgatcatggcctgtgtgccgccgcggccaaaataagagtccatgagcgggaagataaccgtcctgcgcatatcattaaaggtttcattagaaaatttcatattctgtacagttccaaaatggatatcccctcttgctttcaggagggaatttacaaatgcggtcactccgtttttatccatacccgccgtaggattgttggcgttagaaagggattctcctgcgcgccttccatcaggcgttgcccctgtatttctcccatatgtagtattatcacggttattgatgttcaccattccaaagcagtccagtccaaaatattttcctgagatatccagcataatgtaacacaccatttcatggactgccttcatcatgttatctacttcttccagatcatttccgaatttatccaggttcagcagctgctgtctttcctcttcatatcctgcgaaatccgcttttaagatctccagcatcttatctgctgtcattgtctcatcctcaaatacacattttttgatcgcatacagcgaatctgaacaggtaacaataccatagatttcatcacttccgccgcatttgaccgttccgccgctgataacaccttttccggcatccatacaaccgtcatacaggatattgtgaaggtttaaagacatatcttccgcaatgatctcatagccgcgggaatgattccgggcacttacatctgtcaggaaagccacatttttgcagtaggcatcacacaattcatcaaatgtctgataatccgccaacgtagtattgtttggtgtaagccagtatctccctgtggagtcatacccaccatttatggtcccccacagaacatttgccatgttcaggaccgaatttgggcttacgataattctatggtcaatggtaaattccccgcatccaaggggcatccagcccagtgcctctttataactgataccaaagaccttcatcacgcctggaataatattttcatcctgatacagcatcggataggtagttccttctccaataacatccatagccttttcatacaattttggattcatcccttcatacatacgaagcgtcagctgcggcacaatatcgtgtactcctctggacacctccatgatgaccattgccagttatccgcctgttcggggtatttccttcccaaaccgccgatgatcaccctgtcacccgtcacctgttcctttacgatcatgagctgccaaaagcttgtaaggagacggctcgcctcttccgcatcgatcacaccctttgccagatcttctgtataatacaatgccaaataatcatccatccgcccccattcacgggcgccgtctatcatagtataaataatgaccagttgtatcgcctcgcggaaactgtccggtttttccgtaaccagtttccggcagatgcgctccatttccttcaaattttctgtcttcatctgtctcagcctgatacagcccggccgcctgatctgcataccattccagagtcttcataacggtctttaacgccatgcgcatccctaagtagaaattcgggtcattctccggatgttccctctgtttttcttctataagccggtccagaccaccgagtccgcagtctaagagtttatggtaatccagaaaaatccctgccaccctctggagtgctgtcgcagcgtggggatagtttgccagatccagcacttttccgtctgccacaccgcctgtgatcatatagatcttgtcctgctgatccatttcagccagaaatttcttggttgaggtatggttctcccagaactttctaagtgactctaatctggcacgctgttcctcatcaatggatgcatctgctattttttcatcgaaccaatcgaaattcatagcaaatccccactcactgttaatgtactgtgcattcattcccagcggaaagatgtctgccctcccgcagaaaagatcattaggcatgataccagcatgatctgcggaaattgtgcatccaggcatttagcttcccggattgcagggtggtcatccttacagttcctatagacctccgtgaaccgttccatatggtccagcagctctgcaaaatttaaccgtggttcattattatagattgtcgaataaccgctgtacgagtcttttgtacgggttttataagcctctttccaatacattgttttcctcctcgttatgttgttgagcccttacgcttttttgcagcatatcaaagcctacggctacaagaaggataattcccttgatcgccatttgccaatatgtactgatcccgcaaagtacaaatccgtttgtcaacacctgcatgatcagaacacctgcaaccgcacagcttatacttcccgaacctcctgtaacactgacaccgcccaaaaccagggcactgatcacatcaaattcaaatccctttccggcagtcacctgtccggagcttgttcttgatagaagcatgacgccagataatcctgcaaaaaatccacataatgaatatgccagataattcacccgctttaccctgattccggacagctccgctgcttcagcattacttccgactgcataaaaatgacggccaaaataggttttattcagcacaaacgcaccaatgaccagacagataatcataacgatcactaaaagaggtatgaatcctatgtaactctgacctaatacagcaaagctttccggaaatccaaagatgggcattcctcctgcaatgatatatgctgcaccttcaaaaatgatctgagtggccaatgttgcgatcaatgccggtatttttatgttcgcgatcacccaaccattaaataatccgatcaatgttgttgatgagataccaatgactgcagcaataaacggattgacgcctgaattgaccatcaggtacgcgacaaatatatttacaaaggtaaccattgatcctacagaaaggtcaatccctccgatgatcattacaaatatcattcccactgatgcaacttccagcatagccgcctgtcttgctacattaaggatatttgaaactgttaaaaatttgggtgtggctatagaaaatgcaattattaaaacgactaatacaacataaataccgaatttttttaattttttgacatacttattgttttcatatcatcaccttaatccaatcctgaagcatactgcataatacgctcctgactgaactctcccttcataagttcgccgtggcatctgccctcggcaagcacaatgattctgtccgccattcccatcagctcttccatttctgaagaaatcatgataatggtctttccttcttcaatcaggtcatttagcagcttatatatctccgcttttgcaccaacatcaatcccccgggtcggctcatcaaaaatgaccagttccggtgccgtagccagtccttttgcaagcaccactttttgctggttgccgcctgaaagatttttaacagcctgttccagcgaaggggtttttatttttaatttctttttgtaatgtgtacatacttcttctgcttttttgttatttacaacaatcccctttgaaacatcctccagagatgccataatcgtattatcccatatggaaagcggaaggcatacgccctgctgcttccggtcctcgggacacagtacgattcctgcgcggatcgccttttttggacaatcaaaacgtacctcctcccctttccatattattttccctgactctattttctttacaccgcagagcagttccattaattctgtcctgcccgcaccgactaatcctgcaaatcctaatatctcgccctttttaactgaaatgaaacatttttcactccgttccctgtaacaccctgaacatccagcagtatttcattttttacctgctgagctctcaccggaaatgttgatgttaattcgcgtccaaccatcagtttgatcaattcatcgttgttcgtatctgacgtattcaatgtttttattttctgaccgtcccgcataactgtaatacggtcagataaacgaaatatttcaggcatcctgtgagagatatagacaatcccgactcctttttttcgtaaatcctccactaaagaaaatagagtttctgtttcataatttgtaagaggggcagatggctcatccatgatcagcaccttcgcatcatgaacaattgcctttgcgatctctatcatctgccggtatcctactgataaattctgaaccagctcatacgggtcaattttaatattcagactctcaaatacctctgcagctctcctggccatttcctttctatcaacaacaattccccggcgaatctcatttccaagaaaaacattttcggccgcacataaatcacctactgaatttaattcctgatatatgactgcgatgccggttttgtctgccagttggggagtcatactgctgtatgattcaccattgatcacgatttctccttcgtcaggaacaactgcgcctgtacaggtctttatcaaggttgacttacctgcaccattttcaccgcataaagcatgtatctcacccggccggacatcaatcgaaacaccgtttaatgccacgactcccgggaatttctttgtaatgttttttaattccaatattgtatctgacatcccgtcacctcaacttctcaccttctcttttgacattgttatttggaatagtaatcccctacgttatcagcagtcacaggagtaattgtcttgtatacctctttttcgtaggaatcagatgtcataagtgtatccgcacattcaaatgctttctctgccatttcttttgctgttccaaggttgatggacattctgatggcttctcctttactgattgcggtacatgcttcctccgtcgcatcacagcagaatactccgtattcgtccagattgactcccgctgcctaaagagcctcgtttactccaacgcctgagccgtcaccgatacatgcaaatgctttaatatccttatgtgcctgtaacatattctctgccaacgtcataccctccgcagcattcagtgcgctgtcctgcgccactatctcagcatttggagccttttcttttattgcatccacgattccatttgccctctcaacgataaccggaagagtcgcataatcaataacggccacctcacatccatcgggataattttcatttacccatttagctgtctcttctccgatcgcctggccaaccgcataattctctaccagataagccatatctgcacattccatgttctcatcccaggatatcactttgatgcctgcatctgaagcctgttggcatatagatgcaagggcagccacatctgccgggtatatgatcaaaacatcgactgctttacaatataattttctacctgtgaaatctgtgtagatgcatttcactgacaatccaaaactgtaacatcccagcctttttcttttcccattgcctgcatattctctgatacgcctgcaaaaagcggatttgtaatatcctgaaaagccacgcctatggaatatttaccgtctgaactgccgccggaagaactttctttttttgtatctgccccttcaatagaagaaccgtcattacatgccgccaaaccaaaagccatgattactgtcaacagtattgctattatctttttcatttttctcttctcctttttatggtatgattatcatttttccgttttttccgcctatttcaaatgccttttcaatctcatccagtggtatcctgtcagagattaattctgccaacttaagcctgtggctgtttaccagttccactgcccgtccatgagcaaacgggtttacaaaagatgctgttatatttagttctttctggaaaatctcatatggttttaccggaatctcgctatcaggttgagatacaccaaagaagacaacattcgccccctgtccggcatatttgattgcatctttcattgtgttttctcttcccacacattcaatagcaacgtttattttatggatctgattcttttccattatatcaaataaatcctctttcaatggatcaacagcaaaatctgcacctaattctaacgctttttttcttttgatctcaatgggctctgaaacaataacaaccgcggcacctgaaagcttcgctaactgcagcatgatcagcccaattgtgccgccgccgataatcagcacaacatctcctgttttaatatttgcccggtcaatcccgtgtacacagcatcctaccggctcacacattgccgcttcatcaaatgtaacatcttcttttagctgatatacctgcttttctgatactatacaatattcagcaaatccaccatcatatgtaactcctgttgccgaataattttcacaaaaatgcggtgtcccattctggcattccggacaagtgccgcacataatactcggatctactgttacatggtccccaacctttactcttgtgacctttgcaccgacttctgttacaatgcctgcaaattcatgtccaagcacaaccggcggatagcattcagaggctcctttggctccgccgtaaatatgcatatctgttccgcacacaccagccgctttcacctggatcatcacctcatcagcattcggtctgcggcattcatgctcttctaccaggatcttgtttttttcgtaaaaaactgctgctttcattttcttcctcctgaaaatttatttgttaaatttattatatatatacaagcagcgtgcttcaatgagtcagaatttataataggtgcacaaatctttagaatttaaatacaaaattataaataaagagacatacaccaatttcctcaaatggaagaaattggtgtatgtctctgaaaacagaaaagccaatcgctcataaaaaacaattgacttactattctgcctccatcattggactgccttctttatgaaatttttaccgataatgtttccaataccactggcatttttcaatatccttgagtataatcaaaaataacgattcagcagatctgctttcatcagaatcaacaaaggagaacgacaatatgtttcatgacaaaattgccgtcattaccggcggtgtagaaggtatcggcaaaagtattgccgatgaattcaaaaaggagggcgctgttgtctgcgtcattgacaaacagcctggcggatattttaccggcgatcttgccgatgaggaaacactctcgcgttttgcggaaaaagtgatttccgatcatggacatgtggattatttgatcaacaatgcgcttccattgatgaagggcattgacgattgttcttatgaagagtttaactacgctctgcgggtcggtgtgactgcgccgttttatctgtctaaattattttcacagtattttgcacccggtgccgcaattgtcaatatttcctcatcccgtgatagaatgagccagccgcagacagaaagctatactgcagccaaaggcggcatatctgccttaacacatgcgcttgccatcagcttttcaggcaaggtacgggtcaattctgtttctcccgggtggatcgatacctgctttcgtgaataccatggagctgattccatgcagcatcccgccgggcgtgtgggaaatccgcttgacatcgctaatatggtcctgtatctctgctcggataaagcaagttttattacaggagaaaacatttgtattgatggggggatgacacatcaaatgatctatcatggagatcataactggtctctggatatggattaaggagcatataaaaagagccgcacagcaatctctgcgcagctctttaacacttttatgaaatgaattttcctgtaattgtacagtaccatcacagctatgaacaaatacccatgtaaaataacctatggcaggaaggttattacttttgatctagcgattaacaacatttacacaattcccgtccgcaaactcccgcagattgttgacagcaatatctaacagacgttttctggattcctttggtgcccatgaaattttttccaccggttctgcatcttcctccacctcctgcggagcataatccggagccagctccggtgtctgcttacggaaaagcagcgcccagattgtgattccaatcgcagcatctgtgatcagcagcaaaatttttattgtattttctttttagtcttcgacatgaaccgccctgccttcctcttcagttgatttattgctctgctcgagcagttcttccatcaaaaggagcaattccaattcactggagaacggaatcgtctgttctccttctacaattataccctgccatgtattatgctctcttccagtcattgagatatgaatttcttttccactgttcatactgtctgctttctgcatattactctcctttttctcatcctttactccttgccggaacaaataaaatcccggatctctcccagtttcttatctgccgtctcatatccctgacggtaaaaagcttccatccgctttgtattgttgtctgcccggctgaccagtaccttatgagggcggatcagcagtaccttctgctctgactccagtttttccagatactttattgtttcattgtagcgctggtttctgctttccagttgtcttaccagacccggatagtctctgtataacatgcggctcagcctctggggttttcctgttacaggtttttggtagcctttttctcttgtaaggatcacgatatttttttcatagccgcgctccatggcatggcggataggaattgaatctgatacgcctccatccaggtacagttccccgtccagttccgtcatagggcatacaaaaggtacgctgcagctcgccctggcaatccgcataagccgtttcccattatgccgttccgacagatacaccgcttttccggtgcggcagtctgtcgccacatattcgcagtctgtctcggatgtttcataagctttataatcaaagggaagaagccggttgggatattcatcaaaggccaggtcaaaatcaatcataccttttctcctcaaaaagtggctccaatggataggcgggcggtttcttccatttgggatcatacaggcacgagaccttcccctctgcccggaagcgtaatccatggcattgaaagcacccgcagaaactgctgccgcatagggcaggtatatcccatgctcctgcagacagtccagtacccctgctgtaaatattccccggtttgcaccgccttccaaaatcaatcctgtgtttttcatctatctatttccttttgtttcttttctaattattcatctttattggtaatccacggcgccagccgtaagaaaacatatcctttactgattttgacgaattttggaacagctgctctggccggttatctgataaagaaatcactacggtcttcttgagatttatccatttctataggatatttctttttcttgcttcattgattgccgctgtctggcttctcacgcccagcttccggtaattctcactgatatggtattttacattggcaagggtaaggttcagttttccggctatctgcctggcagagagaccttctgcctgaagtctgaggatgttcagcgcattttcaggcagctggatttccccaaagcttcccggatccagatatctgggataataccctgacatctccccgcattctgccctgacctgttcttcaaatcccgcatcctgaaaggtaaattccccttcctttaacattttgtccgtcaccgtcccttctcgtgaaagcacccgtacaaaatgataactctccgcctcactgatacactgctgcatcacttctctccacttttcccggtgaaggccgtacagggcagcgcttaacagcaggcgggattccatccggatataggtccgctgcattttttcggcatagtgaagaagctgttccgccagagcgcacgcccgttcatacttcccctgttggaggtagaccctcactttggtcaggtaacggaaccgttccatagtggcaaattccgccagttcatccggggcctccttcatccatgcctctgccagggcatagtcattgagataaagggatacccggcagacaaaagcgtccagattcttcagaagatttggcgcctctctttcagcccgcctcttaaaggccttcacctgttccatagcatactccgcattcccctccaggatggacagccagcataggatgcccgccgccacgaagccctgctctatcttacctccgctctctactgccagttttcccttctgggccaggctcatgacttcataactgtccaggcctttttccagaaagctctccgccaaagctaacggcaccaggccttttccatatttcccgaggacaaactccacaggctttccgatggacaccgccagttccctgtcatggcggctccattcacagaaatcctttcccccgttcatcatggagggaagattgctagtcacggaaaattccggcaggcagttcccccgctcccggaggagtgtccccgcatgttttaagatctccgccaggttcacgcttcccctgtggggcagaccgatatccagatacagcaggcggcttctggcctccctccgttcacttcccgtatgggtcctggcgtaggtttccagctcacggtaccagcgttcgctttcctcttcgttcatcagcatggactgcagcatgctcatgcctgctatcaatacgggattttccaatatcactttttccggcagcttcagataatgctctttcagttcatagtaatggccagtagccggattcttccggacattggaaaccagtatccgggaaatgctctccgtgtccccatacgtctcgtacatggtcaaggcctccgggatctggtcgtgaagttcataatacagccccgcatggtggtataactgccggatcttctccctgcagtattttttctgcagccggcggcgcatggacatcagcatctgccaccggtactgccagactccgtccctgccgctgagcgcgaaaaagtttccaagctccgctgcccgggccagcagggtgcccacacggctgctgcctgtgatcatctccgccagtccttttgtaaactgatctgcgatagaggtttccatcaaaaactcttccagctccaggtctcactggtcatacacatggctttccaggtaattcaaaaggtcttccctggttacttctatctctcctctatggagcaccagcaggcggaccgcaatgggcaccccctgggtgcattcccacattttctccttttccgcacctgacagggaggacagtttttcctccagataggcatcctgctgctccctgttaaaataaaagtcttcctccgctatggtcacaaaagaataccggatatacgtgtccatcagccatccggggaccggagccctggatatgaggatcagccacacattcctctgttccaaaagagtaccgaacagctctgcaaaacctttgcgctcctccgagtccacgatctcatggaggtcatctataacaacaatatgtattttttcatctttgtcttttttgcagctctcagactgctttccgcgatttgggggagcctgtaattttcatcctgctgactgatactcaccacccccgaattttatacaaaaaactgctctgctctgataaatcatcaatcctgttactcctcttgtcgaactcaaaatattatcatcaataaaagttttttaaatgatttttataattttatcatttacgattccaaaagtgaactagccaaaagtatagtatgattggctttttctgtttttatctctctgttgttaaatttcttgtacttaaatcctccaaaagccttgaagacaaagggtttacaatcctgttttcggcaaacattcacattgaattacgcgtttaaacgctttgcgcatggccttcagatcaaccggcttctttccaaaccacaaagtaccgtaagaataagaacgaaccgaaaaatccaggtcagaaaaccagaatattttcatctccgtggtatactgccggagcatatccatcacttccaggctgaaggttccgtcctgggcaaccaccagcaggtcaaaattctccacacggtcccgcactgccttacagaattccacatggctctcaaatggtattactttcacagtccgcagttcttcccgcccgcattgttttagataatcggccagttgtcttcgttccccggcattttcatcatacagtgctgctatcattagacacctcctagtataataatggtgtagtcaagaatgactactggttaatagttacaaagtccaatctaataaatctatatagatataacggaaggaggagttccccctccatcagaagttataaagtaacattatttaccatgtctgaggtttccttaatgcaccagacaaaagatagaggtataatcactggaggcaggatcattgacgacacctccttgggaaccggccttccggctggtgaaacctcttagaaagtctgtcagtccattcggtggtgatttatgttttggctggttgggaagccccaggctaatacctgtataaaccgctaggttgtgtatccaccttttggaaatggatgcctgccagaaaggataaaaccatgaaatacccaaaagtacttatgatgcttgaaagcatcccttatctctcagtcgggcttgatgtcggtgcagacttcacctggatgtccatcatgctgcccaatggcattctcaccgggaaaccttttaagatcattcattctgatccgcagtcccgtgagcttgctgtcgcaaaaataaaggaagcacaagagatgtattccctcgaaagccgctgcttccttgagtccaccgggatctaccacatcccgctcctgtacttccttcgtgataaggggtttgactgctcagtcattaatcctatcatcactaagaatagcacaaatatgaacgtaaggaaactgcataatgataaatttgattcaaaaaaagctgccaaagtcggcctggatgcttcccttaagacttccatcataccagatgatgaggtcattgacctgcgcaacctggtacgggactactattacttcaaagacctgcagtccgctgtcgtcctgaagctcacggcggaactgaaagtgtcctttcctgcataccggaaggtgtttagcaaggtcactacccaaacttccttaaagcttctggaagcttacccccttgccgcagacatgcttgccgccccaaaagacatacttgtggaaaccatacgcaaaaccgcacgtttcggtgaaaaatatgccgtttccaaatatgatgccatacgtgctgccgcaaaggacgccgctgttttcggacgtgcgcttcaaagcagtgcactccggatccgactgtatatcaaaacctaccgggaataccaggagcatctggacaatatacttgaggacctgcataaggctgttgataagctggaagggacgccggtttatgaccgtatcttccttctccagtccctacgtggtgtcggttttctcagtgcagccgtcctgatcgctgaaatgggctcctttgacctgttttcttccccaaagaagctttatgcttacttcggcttggatcctgccgtgaagcaatccggcaagttcaatggggataaagtccacatgtccaagaggggttctagccttgccaggcgtatcctgcatatggtggctatcaataatcttaaggtggataaagggacaaaaacaccagtaaatccagttatccacggctattataccgacaaatgcaaaagcaagaagaaaaacgtggctgtcggggctgtcatgcataaaatctgcaatatcatttttgccatgctccgggataataaaccatttgagatcatcactcctcaggaacactgtgagcggtatctggcagcgcatcccgacaagatacagaacgcagcctaacaggtttatcatgaattttaaagatttccacatgggtgggcttattaaagttacccttttttacatcaactgcttgaaaaaaacttttttaacatttttcattttacctattgacatttcttagctggacttttcgatctgtctctcattccccataaaaccaccccgtctgacagaacctactctatagactctgtaaacaatctgccatgttcttttgtctccgtcaatctttcctacacaagatgtcaaaaatctgcacaacatgtatcctcaacgttacaatgtgtgataaaataggatttggaaatctattctttcgcgattggaggatgacgcaatgcgaattgcaattatagatgatcttttgacagacctagaatatctgcgcagcaacgtatgccgctgggcagatgagcatgctgtccctctcattccaggtcctgctttatttgaaaacggggaaacctttctggaacagtttcagaaggaccgttatgatattattttcctggatatctttatggaaggtatgaatggtatggatacagcccggcgcatccggaaatgtgacgatgcctgccgcctggtctttaccaccacctccgcagaatacgcggtggacagttatgaggtggattcctcttactatctggtaaagccatattcctatgaaaagctttctctggctctggaccgctgcagcgcggcttttctggaacagggacaattcattattgtgccggacaggggaacagacaggaaactctttttgcaccctatcacctggacggaatacgcagaccgccggatcctggtgcatatgcgggatggaacaacacttaccgtgtctatgaaccaaggagaatttgcggaacaattgttagagtatccctatttctgcgactgcatgaaagggatactggtaaactttgaggctgtggacaagctgtattcagaccatttccttttaaaagacggaacactggttccaatcagcagactgaaataccggaatgtacgggaacaattttccgactactcctttgcacaggcaagaggaggatactaaatgtcagatttagatatactccggcccatgctggaactttctgttgtggttccggctgctgtcttgtgctttctgcccatgaaagggcatttgagggggatgggtaaaaaggcagctctgtttggcattccggcactgcttttatgggcagcggcaggcggcgcagtctgcttttacaatagatgggacggaaatatatgtctcttcccgtcacttataggatttgcattgatcttcagacatatggtagaactgccggcctggaaatccgtgagcgttctgctggctgtatgcggtgtactgtcaagtatcaccaatctggccatcatagcggacgcgctgtttgcccccggcaacactgcgccctggtttgctttaaaggggggagccgtctatatcctgctggcctggatacttctgggcgccttatggtacccggccacccactgtgcccgctggctgttaaatgagatggagatgcccggcacctggtatgtattctggatcgtgctggtggtgttcattggggtgaacctaatgctgcagccgacggattattccttactatatatcaaaggggttctgatattttatccgattttgatacttgtgctgctggccctgatgcttcttttctatctgatgttttatctgatggcacggagactgggaaaaaccatgcggctccaccgggaaaatgaatttctacagatgcaggcatcgcaatacaggattctccagaaaaatatggagaatacccgccgggcgcgtcatgacctcagacagcattttatggcgctccagggctgtatcgagagcggcagcctggaagctgtggctgactatgtgcagtcttatggagaaaaactgccgcctgacactgtgcgcacatattgtaaaaattatgcagtgaacgcgctgctgcgctattatggggaaaaagccatgcaggaagaggtagatatggaagtttctgtccgtatggaagaacatactgttattccggagcctgaattctgtgtactgctgggcaacctgcttgaaaatgcactggatgcctgcgctgtctccaacaggccgcattttgtccgggtaaatatccggcagaccggaagctccatgctctccctcactgtcgacaacacaagctctcagcctcccgtctgggaaaagggaaagctgcgctccagcaggcgtgatgacttcggcatgggaacagaatccgcgcggatcatcgcggaacggtacaacggagatgtgcggtttgaatggaaggataatatattctatgcatcagtcatgctaaatccttgacatgggtatttcataaacatatctattcttaacgtatcttctgaagttcttttctccgatttgaaatgttttgataatccaaatcggaggggggaattttttctgctttaagtacaaaaaatctccacctgttataaagtggagatttttgtatgggttatttcgttattattgaatgagtaaactgtaatctttacagtaatccggaatatactctatgtatcaaaaatactattgtttttggcaataaccctgtcaaagttctgcaaatgaaattataatagtatctcataatccatcaatttcccagcgtatactgagtttctcttacaattgggctaattccccattcctccataaattccttaaaaagcggaaaattatactaaaagcaaggctgtttttcacactgaaatccaaattaacttgttgatccatcatctgctatgttacaattatcccaactactccgtaaccctcataggttcaagcaaaactcatgcagaatcacctctggagataaacgtttttccggctgttaaaggtattcttacagtcagtgcagcaaatgcgtatacctattgaatagttacaatttaccacctaaaataaaaagagaagggattgaatctatggaactgcgtacagcaaatgaaaatgaatggaaaaaagtaaaagccttctactggcagctgattgaacagatggactctgccctatataaacccggatggaaaaaaggaatttatccaacagatgaatttcttatggactctatcagaaacaaagagctgtatgtccttctctccgaaagcaattatatggcctcaatgatattaaatcacaaatgtacagatgggtatgaaaaaatacattggaacattactgccacccctcaggaaataaccgtagtccatgctttaggtgtactgccggattatcaaggacagggaatcgcaaaattaatggtacaggaagccattcggactgccaaagaaaatggacaaaaggctgtccggttagacgtactcagtacgaatatccctgcccagaaattgtacagcgatatgggatttaattatatggataccattcaactgttttatgaagacaccggatcaacagattatttactttacgaatatactctataaagtattttcccatataaaaagttctctctatccgcaatgtatttccattatggctctcatctgaccttcatcttctgcccgctgtatgtatatttcccggtcagcgcggtttgcataggcacgtaccctggcctgcatcagtttttttaagagtgcaggtgcaaaacataggtgtagctggctgcactgaaacttttcacctgtcctatcggaaaatcagaccagtaaatagggtaattaataataaacgatgtaccagaacacccatatttattttatataatcgagtatatctaaaagattatctgtatcaacagaaaacgaagctttcctcttgacctcatccgatgcatttaaagcaattgattttccacaacatttaaaaaccggtatgtctgttgaaccatccccaactgcaacacattcagaaggtctaatattgttctttttgcaaaaatcattaacgcagtttactttattttctgcttttatatagtcactaatttgccctgtgaatttaccgtctatgacttcataattgcttccataatatccataaaagccataaatatcagatactgcctttgctacctgaacaggcccaaccataatcagaatacattttatccttagcttatgcagataatccactgtttcacgaataccttttaatggcctggcaatttccaaaaaacggcttttgatctcactttcctttaagcctgtaaatagttttgctctgcggtagtctgctgtaatataatccaactgtccactttcttcttgtttctggataatggcatgttcttcctccctgccgttcaaaatacagggcagcataactgaatgaacttctcttattaatgtatcatctaaatcaaaacaaatcagttttgttttcatatctttcaccccttgtccgttttatttaattctccaccaaacacagacatccgctgcttctcttactgtaaattcccacacaaaatctgtcaagttatcctgccaatccttaaaccaataaaatatcccttgacaaaatcacctaatattgtatactcaacattgaatatacaattaggaggtaaatatatcatgacaaaactgcttgtacttggactattagacgatcatcccatgtccggctacgatattcagcaaaagatacgtatggcggatgcagagagatggggaggcgtgctggtgggttccatataccacgctttaaagaaattggagcaggagaattatatcgcattagccgatgtcaagcagacaggccacaggcaaaaagctgtatatgaaattaccgaccggggcaaagattatttgcaatctctaatacttgattccttacgtacctcatccgtcctgtaccctaccacactatacagcggattatctctccttgataaaatcccccgtaaaaatgctctgaaagccctggaagaacaaaaaagatcgcttgaaaaagagtacaatttccttgaacaaggtgaaaagaaaaatgcagacgctgaagaagaaattcccctcatatcaaaaatcactattgagaatatgtttgatattatcaggcagcagcaacgattcattgataaactgataaacgcaattgagcatatctgaaaatccaatcccataaactgtgatgcacaccctgtcagacccaattttcagatacactccggaggaataaaatagaatgaaaaacattttgctcctatttacaggattcctgttaataattatcctatcattgatcaccggcaaaattatcaacacatataaattcaagatccgctcaaaaaaaggaatacaaaaaacagaatacataactataggccagatccaacagtatatacaaatccgcggacaggatatttccaatcccatcattctcatgcttcatggcggacccggcaataatatggcatactattcctattattggcaggctgatctggaacgggattatactatcgtccactgggatcagcgtggctgcggaaatacttattaccgcaataaagacgcccaaaagcccactttggatttactgctacaggacttagacgagttggtggatcatattcgttccgagtatcacaaggaaaagattacgatcatggggcattcctggggaacctttctcggtggtatctattcggaaacacatccggaaaaaatatccgcctatatccccataggccaaatgctggacttcaaaaaatcagaacaagtatccgcacgggaagcaatgcgtctggcagatgcggcgggcaaacccaaggacgcacagaaaatagagaaaaagctggagttgataatgtcctgtcaaacccttgacaaacaaaacgccaaagaattcctaaaattccggcagctaaaagaaaaatatctgccttcacaatacagcaataaaatgcttttactccagttgttttccccctatatgacattccgtgattttaaatggatgataaactttaatgcgctcatagaatcaaacagtgaactgtaccaaacgcttttatcggacgaaagatcatccatgtatgaccacgatccgcaatttaaagttccggtgatcctcatagccggagctgatgactggacaacaccgtacagcatggcactcaattattttaaccatatttccccgccggtcaaagagctgataacaatagaaaatacaggacatctcccctttattgataaggcaggtgaattttctgaaatgttgttaaaaacattagatgatgtatggtaccgggtatgaacgcgattctcccggcaccaaattctgtgaaaggcaatacaacaaaggcggtggaatgctttaactcacccatcattgatattaccggaagctttatctacacaccgcagcgcgttcaggcttctcggataaccgatataaggcagacactgggaaatcacacggatcaaaaactgcttgtcattaccgattttcatattcgctgccgcatggctgatcaactgtggttcacatcctccctgcgccgcaagaaaacagaaggtgatcatctctctctgaccatagttaaggccgcttcttgtatatatatctccaaaacagttatctgcaagccaccgatttatatgtctggattcttccggtcctgaccggtaaaagtccttcattccctctccgaaaatatccacctgcgcccggattcccttctccagtctgtcttttcttgtagtgtttgactgtccttcaagaggcatcctgactcctttttccgtcagaaattcattggttacctttaaaaacggaaatactctgccgattccaagataggccgctgactgatagacaatctctttgaccaccaccggtgtcacaccaaaattcatagctgccggcagcatttccctgaactcatctatggcctgacatccgatcagtgccgcaagaattgccatggatcttgtcttatcctcaagctgctgtccgtcttcattgacaacttcatcaaaggcaaagttatcaaaccactccgtaaattccggatccgtctccgacaacgaggcgtggtatcccggaaacattttctcatgatactcttttgaacatttcgtctctgccattatatttccttctttccttatatttctttccttatcgtcccagaatggtttaacatctgctcatctttattcaaaaacctttgctgtttcttttaaatactcgatcaccggcaaatgctgaggacaaattttttcacactgtccacacctgatacagtcagatgctctgccgttatttttcgtatgtaccccgtaataataatcactgttccagtcgccgaactgttttttcgcattaaaacatccgaacagatcgggaatctgtatatgttttggacatccgtctgtacaatagcggcacgccgtacacgggatcgtatccatagtatttaggatttcacatacacgttttactgctttatactcttcctctttaaaaggcctgaacgctttcatgaccgatacattatccttcatctggtccatgtcactcattccggaaagcactttgaatacaccgtcaaaggatgccgcaaaacgaaccgcataagctgcaggactttccccggtacccaaatcctccaattctctctttgcctcctccggaagtcttgccagtcctcctccctttaccggctccatgaccagtaccggcttgccgtactttctacagacctcgtatactttccggctctccacgctggggctttcgtaatccatataattaaactggatctgtacaatttcaatctccggatgctccttcaggatcatatccagtacatctgctttatcgtgaaaagaaattcccatatgccggatcttcccttcctctttcagcttctgtaccacctgatacgcattgcacttcatgaagtgtctgtatatattttcatcctgcgcatgcatcaaataataatcaaaatattccactcctgtggcttttaactgttgttcaaacaatggcctgatatcggactctctttcaaagaaatgtacagagagtttatttgtcaatgtatagctctctctcgggtatcgggcggcaagacagtctctgacagcagtctcacttttccctcccagatatccatgtgccgtatcaaaataagaaaaacctgcctccatatagtaatcgatcatgcggttaaattcttcatagtttacgtcgctgccgctcatgggcagacgcatacatccaaatcccagtttatctatcatccttgacctgctttctattcttaaatcccagtctcaccaatagtagtctgaagtcctattctctcgtatcttttgcttctcattttaactgtccgtattccgcatctgggacaggctcgcaccattcatttctgcagttctcaccaggcacttcaatagccaggtgctgaaaaaaagagtcaggagcagccccatgccagtgtttcacctctgcccggatatgtacaatatcccccggcttcagttctctcgcctcttttccccattcctgatagtaccccctgcctgcagtcacaagcagcatctgcccgccgcccttgtctgcgtgatgaatgtgccagttattacggcagcctggttcaaaagtcacattgccgacaaccacctgctcaagcgacaacatatttaaatagctctgaccgataaaatactttgcaaacgcgtcatttgtttccccaatgggaaatacactcatttcttccggtttcatggattcgtcctcctgtttattcctgtcaactggcatgtgatcataaccaacttttgatatctttttcagatctgcttacagctccgccgcgaatagacagcccggcttctacgttagcgcccggacatagccgcttgatgtcttttatgctgctgcccattccgctcccctcatgagtgcagagaggtttgatcgtttttcctgtaaaatcaaaatgctctaaaaacgtaaatactgccatgggcattgtgccccaatagctgggataacacaaatatatttttgagtagttcaaatgttccggataagatttaagctcaggacgtgcatcccgtttttgatccgcttgtgcctgtgcaatgcactcgttataatcttttgaatatgcctgcaccggttcaatcttaaacatatccgcgcccgtcaacttctggattatacctgctgcgacctctgtgttgccaatctcaagattttttatctctccgcttacatagttctcatattttcttgagaaatatacaattagttctgacattacgcttccctccaatctttcttactttgtattgtatcctgcgtctcctttcttttgaatctccaatatgtcaccagcgtataaacttatagttaatgccatcctctcaacgaccggaaggcatgtaaaatgcacaataaaatagcagagaaccaggccactgtgggattctctgctatttagatacggatatgtccggtcttacaatatggtcagaaataattttgacgatcaggtccgcagaatctttgcagtcctctttaatccattcatttacaacactcaatattgctcccatgtagaatcggagaatatactttctctcgttctccggtatattaaatcgttccagtatggggtttaaaacatgaaagaacaatccatcaaaattatcctgtaacctgagatctgctgatttgcgcactgctgtctgaaagagccttttattatcctggatatatgtcaaatatggggacaaatactttggtgtcactagatatagctccttcaaagggatatcccccatgttctcgatgaagctttctgctccctgtggaaaatattccagaaactgggcgttcatgtatctgacactttcagccagcagatctccaatggtttcataatgaagatagaaagtagagcggtttacattggctgtcttgcaaatctcttttaccgtaatatattcaaaatctttgtgctccagcagatcaagaaatgccttgtccattttcactgcagtattaaaatacttgctttctgatttgttcaaaccgctctcctcctcaaattcccctgccttctttggaatgtatctaaaaattatttccgtcaggctgtgtgccacaagatctaccgcaaagtagggcgtgcagattgtgaaaatgaagtttcagatacacctaagttctcactgatctccttagccaactgcatgatctcaaatgcatatttttgttttctgctttcacgcacttttatgtaaataggataattgatgcccattccaaaaagacctataacacctattataacgcccaccgccatagacccggccgttccggcaccaatcactcccatagaaatgcacatacctgctcccataagtaatgccgccgcaattcctaatgtgtaagctaaaatctccgctggaagcttaaccctctgatccagtttcttcagcgcaactacctttgatgtatctttgggcgcatattcatttgcaagtgcctctgcatatattttatctgtgttcatgtcttgaacctcctgtttttgatatactcattataggagattcaaaacaggatctgaacaacacgaatcctcttttgtgttgatttcacagcttctattgctccaatcccgcaaaatgtcccgtacaacaaccgtacagcaatttcctgcggcaaacagttttcttcaccatcataaattgctttcccgtcattcctcccgggtacttttctatcttgttgttcctttaattttttcggtataatttattccctatacaatttctgatcaaataaattatatcataattaatatgaaagaacagtattgaatatttatacacatatatccaatactgcgctataaaggtgtattctccattgatccgaataaatttatcgctgttttatctgcctcatctgttttatctgcctcatctgttttatctgcctcatctattttatctgactcatctattttatctgtttcgcctctatttccgcagacctgccaaacggttacaatatacttcacatttgcttgacccaaaatctcccatatgctaccattgtataaacattcagtttatgcaaaaacaaaggaaagaggtggcctatgtataaccgaatactcgatacttttatagcggtggctgacagcgggagctttacaaaagccgcggactccctgtatatctctcccactgctgttatgaaacaaatgaatacattggaaaaagatctgaatctggtcctgatggagcgtaccccctccggcatctctctgactgctgccggtgctgtcatttatcgggacgcaaaatttataattgattactccaaaaaatcaatggcagacgccagaactgccatgcatctggctgacactaccttttgcgtgggcacctcattgctgaaccctgccaagccttttatggatctctggtatcgggtgaacaaagattttccggaatataaacttcatctggttccctttgaagacaaccatgaaggtattcttgcagaaataagccagcttgggaaaaaatttgatttcctaatcggggtatgcgattccaaatcctggctcagcctctgcaatttcctgccgcttggaagataccggaaaatggttgccgtgccgagagagcaccgccttgccggtaaagaatctattactgttgaagatttgtatggggaaacgctgatgatggtaaaacagggggattccgaggtcaatgatctcctgcgcagcgacctcatgatcaatcaccccaaaattcatatagaggataccccgcagttttatgacatgtctgtctttaactgctgtgcagagagcgggaacgtcctgcttacgattgaatgctggcaggatgttcacccgggactggtatccgttcctgtcagttgggattacagcattccctatggattgctgtacagtctggaagcaccggaggatgtataccggtttgtcaatgaagtgcgcaggcttaataacatcaatagttcccctgccaacctcacaaagaggtaactttcctgaaaaaggatatttcttagactctgatatttctaatcctttatgaatattcataagcttgattttcgggaaccatttgatgttattttatgtttagaagaggatgtgcaaccgcatccctaattaagtacgttctgtgcctgaatatcctttcgatacaaaaatttgaacacacttctgatcagcggctgaataaaaaataactgtgtaaaaaaggcaaaaggcagattgaaacagatcagtttaagccattcagcaaacagcactgcaatattaaagcctgaataataaggatagtacagcaatgaagcaatgaaactcattgcaggacacatcaatcccacagtagcgcatataatagctgtctcaaataaaacagggtgcgtctttgacgggtcaaatactttagatgctaacttataagaatatggactgcccagcaacatttccaataagtaagcaaaaccaaactcgacaagtataactgcccaaatcggaaaatgactcccaaacatataaataccaccctgcttatttatggcagctaagacatttgttgtacctgtaagcgacatcaatgtgccgccattcacaacatacaaactgtaaaaaacatacccatgtactgtaaccagtacggtaagaaaggcgtaaaccattctttgaaattgatttcttggcataataaccactctccttaattaattttgaacgcaaaaaaaacacatatatcccctttttaaatccatacgatacttacgtcccgtaatcagatttacttaccataggtaatacatgtgtcgtttgcgtaaatacattttatcaaaaagaatttgttttgtcaaaaccctttttctgtttcctgctaaacttttctggttgtacctgcagttcacaatatgatatagttaaccaatacaggaactctatgaaatgcgctccattaaacagccctcgctgtcttaactgatgaatcaattgggaggtaatcatgattcgtattgctgtgtgcgacgatgacacagattctatcataaataatcaaatcatattgaaaaactgcctcagccggctcaaagccttggccgaaatacagacttacaataacggaaaaatgctgctgaacgatattttagaagataacagctattatgatcttatcctgctggatatcgaaatgcccgatatcagcggaatggaaattgttcaggccataaaacctgcgcttcccaatgtaaaggtcatttttattacatctcatgtaaaatacgcgatcgacagctttgaattgtccattttccgatatgtacccaaaaatgacctggataagagactgacttacgcggtgactgatgcgctgaagctcatcatgttagaagatgataaaagctatactgtgctgactgcaaaccggatggaaaaagtgcgctatagcgatatcctatatatcctgcgtgacggaaaaaatgctgcactccacacctgtcatggtatcatcaaggttcggaaaagcctgctgacggtatgcggggaattggagagcgaggaatttatatttatcgaacgcggatgcatcataaatctgatacatctgacccagataaaaaacagcagtgtttatctgagagacggtaccatacttccaatcagccgctcacatctccaggatgtgaagatggcggtcaattcctattgggggaaacacatatgatgattgatatccttgaatttctgcttttattttctgcggtactgtgcggtgttctctggatcggaaagctgtacggtgatgacaatgggagacacgcggcatgggcagggatttcggctatagccgcggcaatactatgtctttacagcagcacaaagaacgctgccgtctctgccgttatccttttggccggaattattgttgtttcaaaaattttgtatcatttagactggaaactgctactgtactccgcttgttcctatctgagcgcactctttttgcttgatcttattttttatctgctattatgcagatatttttctaaatctcttgttttttggcttgtatttttagttgtctgccggattccattttatctggccctttttgcctcacaccgattatgggaattcatcagaaattcctgtgattattataaatctatatacggaacttctgtggcggcattttgcggaatcaccatattactgcatctgacgtttgccggtcaggatataaaaacattggtcaccatcagtatcattgtgctcacagctctttttctgcgaattgcgcttgcacacagccatgtaaaataccggcgcaaaaaagaattgctggataccattgaaatgcaaaaggaattgctggaacagaactatactgcagtaaacaatgcttactctcaacatgccaaactgtttcatgactttcaccgtcatttagagatcataagacagatggctcgccaatataacgccccggagctatctcaatatattgattccatcataagtcctgtacagaatatatcctctatcgtatggaccggcagccagacggttgattatatccttaacagcagacacgcaaaagccaaagccgccggtatttcgatggaattgaacatagaatatccttataacaccaatataaaatcaaatgatctgtgtacgatcctttcaaatcttctggataatgcactggaggctgcctcggctgtgagcagggaagggactcccaaaacatgccaaatcattcttaccatacggcgtattcaaaatattctggttatcaaactggaaaacagcagccctgaaccgaagtatacaactgacggaaatcttgccacagcaaaaaaagacggggaccttctgcttcacggctggggtatgaaaaatatcgaagccgcagttcaaaaatacgatggggttatccaaaccgcttatgaagaccacatattccgtactaccatcactatgtactttgaaggtgtagaaatgtctaccactctttcttctctgtgatccgcacagaggtccgaattgaaatacctacaataactgcaagataaagaatgagcaggcatgaacccaggtacctgttttctgcgatccggctgaacaggagactggtgtcgatgtctgccttttccaccacaaacatagtcaaaaggattcctgctactggtacatacataaaaaccctccctttaataggcccaaatttataatatgcgggaatctgaaagcagacatatgtaatataaagcaccatgccagccagtgctgccatgatgatttccgggatagctgcagatattcccaacagaccaaggatcaccggctgcagaatgctggaaacggtcacagctaaaagccccatcaaaaacacatgcagatatttcccgcagaccagttcctccaccgatataggaagaaccctgtaaagcctctgcatattatttttatctgccacagaaaacgtatatatggatgacattgccatcataaacattgcaaatgagatgcccacaaccaatgtacggtagagcagaataaaagccagcggtataagaagtgtaaagcagatggatttatagtaatatttcaaaagtttaaagtctaatttagcagccttgcatattttcatgatcaaacctctcctttacttacaaatacaataatatcatcaatagacgcatgtctgatctgcagacccgaaaagtctgacagcctctccctgctcaccaaagcctcaaaagaatccggatacattttaatattttgcgtaacatcttttatatccggcggtaattctctgctgtttcccgaaacaataaaatatctgtctgtaagaccctctttgtctccggaataaagcagttttccccggttgataaacgtgatgctgtcagcgaccttatttaaatccggtgtaatatgtgtagaaaaaagaactgtatgccttttgtctttcgtatacgccaaaaggatatcaagcagttcatctctggataccggatccagtccgctggtcggctcatccaggataagcagttccgctttatgtgaaaaagaacaggccagcatcagcttcatctgcataccttttgaaagttccatgacacttttgttcctgtttatctggaactgctctaaatatttgtaataaatttctgtatcccagttttcatagaacatccccatggccttttcaacatccgccatcttccactcgtcaacaaaaaaatgcgtgtcaaagactacccctgttctctctttaaacttctgttcctccctgatatggtcaaaccccaataccgtgatcgtaccggactgttttttcagcaggttcagtataagcttgatcgtagtcgtcttccctgatccgttgggtccgatcagtcccatgatagatcctgccggaactgaaaagctgatattatctaaagtaaaatccggaaatattttcgttaatcctttcacctgtagtgcttctgtcatgataaatccctccgtttttcttgataaagcaatcttaccgcaggaatgcacgctgtgccaaaatgtccgtaatctgtatcccgatgtccgtaatccgattactgttcaccggccaccgccccgggagacgtttttcccaaggaaaacctgtattatattgccaacgggtttaaaaaactgtataatgatttaatatatgtatgcttgtagctgcgtcgggattgtcttgcaaatgcaaggcaacacctggcgggacagtggcggactgaactgttactgcttgtgtttctgaacaccgagaatcattgacagatatgccgggcagggggatacctatgccggtatgattcctaccgagataagttcaaaaggctgcataaggaaaatagatttgattttccggaaagacgaataagttatgaatattttctttcaaatttgtataggaatgtcaaccggtatcattgccggttttgtgtgtgccggaataaaacagctttttagaaaagaatatacagaaaaggaaaaagcctctgcccagcagcttataagaaaactggcgtctgttttaaaatatattacatttttactgctcattgtaggccttatttggtgtgtatattttttaattttgggcgctgtcgacccaggccagaccgattacgccaataacatggcagagttgatcgtatctgttcttacggttatttccatcatttttgcttttgttgagtttttgaagcgaaaagataatgattaaaacaaattggagcgatataaaatcatgaacgtgagggtgagaaaagcagaatacagtgatttagacaaagtcgaacagttatatcaggaattaaacgattatctcgctgcgcatgaaaactatcccggctggaaaagagatgtataccctacaagagaggatgcagaggaaggtttccggtcaggcggactgtatgtagcggaaaatcaggggaaaatagcaggtaccgtaatctttctgtatgaacaggacgaagtatatcgttctatcaactggcagattgatcctgacgctccggtgattatccttcatattctggcagtccaccctgaatattttggctgcggagtggggaaagcgctgctggatcatgcggaatttcttgggcggcagcagggaatccgggccatccgtttagacacttatgagaaaaatcttcccgctgcccgcttatatgaaaagtgtggtttccaatatataggactggctgacctgggactggaagaaaccaccggactgaaatggtttaaaatttacgaaaaagttttaataccacatccccgtttagcagcctgtgaacagtaagacaggacagcgtatccatcctgtctttatatttagaatactatctttctgtaaataaaattgatgagcatattttcatacaatcattcacggttaaaacaccccaggtttttttattggcaggtgaagcaggaggtataaaaacagcatttgcgatcacatcactctggatctttccaagattcgtaatgctgtatcccttctgcgcgccatatccaaacatattttttcctacaaaagctcccgctttactctcaaagccgccaagggttgatatggcaaccgcgtcgatcaattccggctgcatatgcagataacacgcaagtacaagcatttctttttgaggatgctttacaatatcttccactatagaggttatcttttttgccagggaaatcatatctttatcccccttcttcacggaaacactaaaagcagtcgaataattccccatagcattttctctgtagcatccggcttgatggcggatatcagcggcaatgatcacttttcttacattatcttcccgcatcattttagcgatcagatagtcatttacagaaaagccgtgttgtttacacagcgcctgtatctcctcaaactcctgcccctctattgtatgaatttctctcctgacgctgtttgtccggatataacttttttcaaaatttaagtatgtatcgtacaaaacctgatgctgttcctttttccatcttctgtttgcatcatttataacgactttgctgataaaaggcaggtcacaattcacgggcagatcatatatggattgaattaattgttcttccacaaaagaaggagttaccccttctccataatgctgtgcgaattccacaaccagttgtaaaagtcctctcccgtcacatagtaagtggtgagagacaaaaagtatctgaaattcattctcatttggataaaccaataccttcagcatacattctctcctgacatcccagccgtgacttgaaatatggttataatcctgctgccaccaatccggatctgttcctatcatcagagttatatccaagtgttcctgcaattgataatacagctttttcgtatctttttcttccgcgatcagacttcgcaaaaacggatgcgctttttgaagagccttcacactgtgcatcacctgcactttatcataattgctttttatctgcgctaaaatcccaaagtgcatattggggcacatataatgtgcacgttctgtattcacataattcttatttgaattcaccatttttcctccggtcctttattttcgcataaagcaatatcataggatggtttttatgcttcacttcctgcattttctccgttttcacaatgatatgatttaaaacctgcgcatgcttctataagcagtttctttatttcttccggcgctatgtttgttgtatttgtggaaacgatcgccgctatgccatgtgcaaatatccatgtttttacaaacacttccggttccatggcaacgggaatatttttcgccaaatcataaaggctatccagtcttgtaccactatccgacatacataatagatggaataaatttttttctttttgagccagttctacatacttgattcccatacttaaaaaatagggaacttctgtatctgcaggaggctgcagcatgacttcctcaaaaaatttttgagtttttttataaacttcttcctttagctcttccatattacggaatgcgtgaaatatcggttgcgtagaacaatgtaattcaccggcaagcagacgcgctgtcactttttcaaatccatatgctcttgtcagctcgaatgctttctgggcaatggcttcttttggtatctttattttaggcggcatagaactctccttaaaataactatgttatatatcattgttattataaccgacccattaagttttgtcaatccggcagagaaaaccattttccccaaccccttttttaagcatgaaaaaaacacctgccgcttgaccgtttctttcggtggcagcaagtgcttttgttctatctaactatttattcattttatccggatatttttccactcatattctctaataaaatctgtcgtcaccattatccattaacttaaacttctcaactaaacctcttaaaagctgtgcctgggaagacagttcttcactggctgcagcactctcttctgctgttgccgaattggtctgcactacactggatatcatagtaaggctgtctgttaagtgatgtatggcatctgattgttttacggatgcatctgtaatctgattcagcgcctctgttacactgtcaacccctcttaccacttccttcagtaccgcgtcggtttcatttgctgtctttttaccattttcaacggaccggagggacttttctattaatgcggctgtacttttagatgcagatgccgatttatttgccagattacgtacttcttttgctaccacagaaaaaccttttccgtgttcaccggcgcgcgctgcttccactgccgcgttcaaggccaggatattcgtctgaaaggcaatatcctcaatggttttcatgatcagacggatctcattggaaccttcgctgatctctgacatagctcccagcatatccttcatacagcggctgctctctttcgtctgcagcattacattttccgctcttttgctggcttcctgggcgcttctggcattttcccccacttgatcagatattacactgatggtaccggacaattcctctatagaggaggcctgctctgtagccccgcgtgcaaggatctgggcaccggatgacatctgttccgaaccggatgccacttcatctgctgactggctgatctgaaacagtgtatcgctcagactgctgtttatatgctgcatggactgctgcagctgtgtaaattctcccacataacactcctcacgaaaactctttgcactgaaatccccctctgacatttgcttcagaagctggatctcactctgaaggacacaggataaattagctgtcagactgcgtatgttatccgcaagaatccccatctcatccctggattcatacatgattttcacatccgagaattcgcctctggtcatactgctgaccgcctctttcagttcatctaccggccgggtgattcccctggtgatataaaccccaaagacaatactgatacccacgctgatactgctcagcaaaagcagatttaccattgccttcttctgtttatccctcagtccctcaaccagttcctccccctttttctctccattctccacaaggctgtctaactctttctgggcctcctgaatgaccagcacattatttttctccatataatcggcagcttcggcattcctgttctctccggaaagctgaaggactgtttccctcattggtgccagttttgtaagcgcagcttccagccgttcaattatctgctgatctcccataaagtgttcccgaatgatgggcaattgttcctgtatgataagagccgcgttcttggcattggcaatagcatcattcacaatctccggatctgaattggatatggagcgatatacagctttctgcatcctctcaaaattagtattgataacattggcactttcattgacagtaaacggaccatcataaaaagtttctgtctgttctcccaggaccatcaagtccaccacactcacaatacatcccaaaataagcatggccagaatcaaagcataagatataaataattttcttgataattttaaattcttcaattacagcggcctccaatcccttctttctcttctgctctgtaaaaatttcctgaattgcactcatacattggattatagcatataatctaaaagaaagaaacgaaatctacgagatgtctgctgcgtttctaatatttatgatttatgctgtctcacaaatttatcaggatacattccgtgttcattggactgcagcgaaaagcagcattcaaaggataatttttttcctaacctcatatatttttaccttttgtacctgaaaattttaagtccagtattttcttgatatcatcaaaatgttccccgcaggtgacacggtactgtatccagcctccatcaccgcagggatgcttatgatcaatatacctctttgtatattcctgcatctgtccatatatagatgaaaactgcttgtcagacaatcgaatcatcaccgtaaacgcgccatcctcaggaaaaatattgcatatcagttttgatcttaccctgtgggcgattccccagccatagttattgccatatggaaaaacaatcttttctgccgtctcatatgtattgctcagcctttcattgagcaaagtaaaccacttggcagtcccgccgcaatatgccgtcatttcctcaattgacggtgtctcctgtttattcaacattctttcatacatagaagcctctccaatctcatttaccgaatgtacttatccactcctgcctatccctgccatttatatcaccgccagcataaccgttcccaaagtaatgagcacaacacctgcccccgcctttcttgacagcttttcatgaaatacgatccatgaaaaggctatcgtgacaagaatactcagcttatcaatgggaaccaccacacttgctgctccgtcctgcagggcacgatagtagcacagccaggaggcacctgtcgccagtcctgacaatacgataaaaaacaactctctcttctctattttctttatctcatgctgctttccggtcacaaaaaccatgatccatgccatcacaagaacaaccgttgtcctgatggctgttcccaggttggagtccacatctgtaattccgattttccccaaaattgccgtcaggcttgcaaagacagctgacaaaaaagcaaaaatgatccagctccctctgcttctgctgtctcccgcctctgtctcttttctggaaatcatcagcattgtgcctgcccctatcagaaaaacagcagccagcttcgcaggtgtcaccccttcatggaggaaaatgaatgccagcagtatggtaagaactgtgctggatttatcaatgggaaccaccttattgatatcacctgtctgcagagcacggaaataacacagccaggatgcccctgttgccaggcctgacaacaccagaaacaacatggtcctcccagagatctctccgattcccgcccatgcgtctgtcaaaaataccagcagccatgagaagaccagcaccaccaccgttcgtatcgctgttgccacattggaatctgtctttttaattccgcattttgccagaatggatgtgatcccggcaaaaaacgaagaccccgctgcatatactatccacatgccttcacctcccatgcaataactactgtgtccgttctctctatctgcataagctctctgtcccgcataagctctctgtcccgcataatctttctgtcccgcataatctttctgtcccgtataggctctctatccgcaaaacggtccgcaggaatttcctgcgaaccgtatcattgaatatttagattcagataccactttccgtcatcacatactgccgcccacggatccttcccaggtatccacttcttttgctttcttctcttcctcgtcaaaccagtgggttgtgactgcttttatctctgtaaagaaacgaacgccgtctttgcccagacagtgcaggtcaccgaagaaactgtccttgtggccgctgaatgagaaaatgcctgccggaacgggaattcccacattgattcccaccattccgccgtctgtacgccgtgcaaactctctgctgtaataaccgctctgggtataaatgacgcttccgtttgcaaatggattgcggttcatcatttccagtccctcttcaaaatccctgcagcgcttcacagccaggaccggaccaaagatttcctgctgtccgatagccatatcttccgtcacatgatcaaaaatggtcggccccaggtagaagccgttctcatatccgggcactgtgatgccgcgtccgtccagaacaagcttcgcgccttcttccacacctttttcgatccatttttctacctttgccttatgggccgcatccactaccggccccaaatctgtcgtcttgtcataggcaggccccactttcagttcacccgcgtattttataagcagctctaccagcttgtccgctatgctttcctgagcaaccaccaccggaagggccatgcagcgctcccctgcacatccaaaagctgaattgatgattccccttgccgtgcgctccagagcggcgtcctccagtaccagtgcgtgattcttggcctctgtctgagcctggacacgtttgccattggcagctgcaataccatagatatgttttcccacacctgtggtaccgacaaagcagatccccttcacatcaggatgcgtcaaaaactgttcagattcctgtctcgtacaggtgacaatgttcagcacaccgtccggaagtcctgcttcctgccacagctctgcacagcgcagcgcagtcagcggagtcttggaagctgctttgatgacaatggtattgccggttgcaatacagataggggtcatccatcccatagggatcatacccgggaaattaaaaggagcaatcccggcaaatacacctaatggctctcgataactgactgtatcatatcctttggaagtatccatcatagactctcccatcataagagtcggagttccgcaagccagttccacaggttcttttacctttgcaatatcaccggcagattccttccagttctttccgtgttccctggcacagcactcggtcagctcgtcccagtgctgatccagcagatcccggaatttgtagagcacctgtaccctcttcatcaccggagtatcacgccaggccggaaatgcctttttcgcgcactctatggcatatgccacctcttctgcggtacagctggggatttccgcctgcacctcgccggtacttggattatacaccggagtgtactttcccaattttgtgtccagccactgcccgcctgccaggtatttcatttttttcgcttcgcccatttcttacctcctaattctgcattctctgtcaactacattcctctctcaagatatctccattataaaagattatctttgtcagttcaacctgtattttacgacaaaaaatattttttttgtgcagaagcaacaaaaacctggctgtacatacctctgtgctttgatttcccaatatctttttcagcggtaaaatctactgtctgtcacagaatacatgcctcttggggtaatcctgatttccgggatcaccggcagtgccataaaggacagggcaataaacgggtccatgccctgcggcactcccatttcatgggccttcaggatcatcctctccagcttttcgttggccttctcaaaacccatatctgtcatcagacccataataggcagctccagcgtctcataaacctgatgtctgtgcacaagagtatatcctccctgcgtccggatcagttccctgactgccagttccatatcttcatcattgtcaccgatcactatgatgttgtgggagtcatgggatacactggatgccgcggctccacatctcagaccgaatccttttacaaatcccacgcctgtcatccctgtctccctgtgtctctcgatcactgctattttctgcacttcaccgttttcctccagatcatcctggcagattttctctgcagtgacgtcctttgtggtaatctgcccttcctccatctgaatgacatggcaggggaaagtaccggtgtattttagtttttctcttgtaaaatctttcacatgcactgtatttttcagctcgccaggacatgcatggaccggacagacctgttcctcttccactcttcttcctttatagtagacttcccggacttctgcctgctccaggttatcaagcacgagaagatctgcctgatagccaggtgccactgcccccagatgggacagcccgtagcacctggccgcctgtatggttgccatctggattgcgtggaccgggcggatccccagagcaatggcttttctcacattataattgatatgcccttctctctttatatcctcaatatgtttgtcatctgtacaaaaacagaacccgtccgtgctgacatggttcttaacaattccctgtacaatgtcctgcaggttcctggcagcgctgccctcccggatgagaacggtcattccgtttctcctctccctcattgcataggaaaaatcagagcactcatggtctgtcgatattcccgccatcacatatgcctgtaaatctgcctcctgaagaaatggtgcatgtccgtcacgcacccgcccctcaaaaagcttcagcttttgatgcatctcgggaccgccctcaacaacagagatatagtccataacctccccaagtcccagaactctttccttctgcagatacggcgccatcatatctgccgtgatcctgcatgcattgtcatcaattccggtagccggtacacaggagggcatcatgacaaagacattggccggcacctcctctgtctctctcagaatataatcgatcccggccatcctggctacattggcagactcatgagggtcgacgataaaggcagtggtaccgcacaaaacagcctgggaaatcaattcctttggtgtcacaagtgtggactccagatgcaggtggctgtcaataaatccgggacacacataccttccattcaggtctttctcccggataccttcgtatctgccgatcccggtgatcatcccatccgccacagctatatccccatctatgatctctcctgtaaaaacattaacgatctttgcatttttcaaaacaaaatctgctttccccaatccacgggcgatatctgaacatcttttatacatttctaaattcacgcgatcatctcctattttccactgccttacaacagtcctgccagtgtgttccacagtatagtcatatcaatgggctttgccacatgggcattcattccggcctccatggcctcctgtacatcctcagcaaatgcattcgctgtcattgcaataataggtatggttttggcatccgctctgtccattctgcggatagcacgggcagtttcatacccattcatccgcggcatgcggatgtccatcagaactgcgtcataggttccaggcgccgccctttgaaattcttcaaccgtctgcattccatctgttctgaccacagatcttgccccgtgcattttaagcagttcacacaggatttcagagttaatcgcattgtcctctgctaccagaaaacatcggtctttcagaatttcagacgcatcctgcttctctgactctgtatccctgtcctgctctgcttctgtctcttcctgcgcggcctcacacataagctcaacacagaacacacttcctttatggggtttgctctttacccatatcctgccgcccataagatccacaaggccttttgtaatactcagtcccagtcctgtcccctcaatgcccattgtgttggtattccgggaaaaggcttcaaagatgtgctccacgaactcttctgtcataccgattccgttgtcactgacagtgaatcggtagcatacctgccctgcctgacagtcagaatctgtttcctctgccagaaattccactcttccgccttttggcgtaaacttaatggcattactcagtatattgatcagaatctgattgatccgcagcctgtccccataaaacttttcatgcctgatccctctcatctgcatatggaactccaggccattgacctctgcctggggttccatcataactgacaattccttcagcatttccggtattgagatctgcatacggttcagcatgatcttggaacgctcgattttactcatatccagtatatcgtttataaggcttaacagatactgggaagaggatgaaattttcttcagacagtcctccaccctgtcccgttcatccagattggccatggcgagagatgtcattccgatcacggcgttcataggtgtcctgatgtcatggctcatggaggaaagaaattcgctttttgcccggttcgcttcctctgcaagagccagggcttcctgcagggcatcctttgcctcacgctcagcagacagcatatccgtcacatctgcacgcaccatgcagactcttctgtgtcccctgtctccccagagcacattgacctgcttgtaccgcagtccgttctttgactggtacggaaggacaaaatcatatcccgaaggtttctcttccagtcgcttcagcatattgtctaaattaaaatattgctcattctcctcctcaaaatggctggtgatataaaaatccgtaatattttttaccagctccctgtacccttccaaaacataaggggacagattctccagcacggtctggcgggtgtacatggtcacacgcccgtcgttcacatccacaaaagccataagttcaaaggtatatgccaccacattaagcatgctctgctgttcccgcacagaatccgtgatatcggttctggccagacatacacgtccaagcctcaagtccacagcagaaaccgtcatattttttgtgagcacctcacccttctcatctgtcatagaataatggaaggaatagctgttctgtcttttcagatgctccatcatgtattcacctgtaagcatcctggtgacatgttctttatctctgggcacgatatggaagcagtacctttcagcgatccaccgggagtagcatccttctggataccggtcttcttctgccgccccggaacttgtgaggatcttatacctgtcattcaggatgtcagcatcaacgactagatcataactggtaactgacaactgccttaatatacgttctgatataacctgctccgttatatccgtcactgtcaggatcccggtcacaccacctgtatccggagtttccaccagattcacctgaaacttcacataccggccgttctgttccttcggaagcttgacaaagcactccagtatctgttctgtatccccgtttttgaacgcggcaagtgcaggttcattgagataggtatccagaaagacctgtctcatctccgggtccgtcacaagcccggcaatgcctgtaaagaactcctcccttacgtttccaaaggtttttagcagatcagaatccgtgtagtcaatgatctccagtattctgttctgggtaatattgcagtgccctacgatcagggcgttgggtcccggtgtgcggtagtgctgcaggataagctcattatactgcttccgtatctgcaccttttcctcacgctctttggttatatcatgatatccggcatatacgcggaattctccgccggcactttggatcagggtaagactgttctttacccatacataaccgccgctgcctgtctttaaacgatacaccatctcacagggcggcccttcgcctgccgcaaggtaatcctccatacgcctgttcacaaattccctgtcatcgggatgcactccggccaaggcatccttccggtaaatatcccaggcttcctccatagacattttagtcatctcagcaaagccctctgacagaaattcgggtatcattctgccgtcctgctcgtactttactactgccacgcctcccggcagatactttaatacattttggaaatactcctccaaacgctctttttcactttgagtcttgatctcctctgtgatgtccctcacatatttgatgtatgcgggaataccattccaatcagtctcccggaagcgtacactgtaacagcggttattctccgggtctgtcatccgatgctcttccccgtccggatgatgatccttctgtgtgcagaactcacagggactgtcctttccatacatggccttataacatttctgcccgagacattttttcccattattaaacattatctttgactcattggcatacagcagatcataattatcccttccgataacatagatcccatctgctgtatcgttggcaatactttgaaacaatctggcttccgctgacatgcctgtaaagaccgcataaaactgtactgcttctgaacatgtgtccattctccggcctcttaagtggatccagatcagtcctccgtcccgatgccttattctgtaagagacatccagcaccttgccgttctcaaaagaggaccgcatggctgacagcacacgctccctgtccgcttcatggatcagccggaatgcatcatactcctccagctcttctcttgtatgccccgagagcgccatcaccccatccgatacaaaaatcggcgtgatgcgttccccttctatgcggtagctggcgatccctcccggaatggaattgatcagatggtccatctccaactgggtctccttgatgtctgaaatattgtggaatacacagtggatcagaggacagccgtcctcctccccgatccatttcacatggacgcgcacccacacagtatgtccgtccctgtgctgtttacggaattcaaatatggtcacttcacgggtacgtatggcctcttttactctttcaatgaccatttttgtgtcttcccaatatgtcatttccgcagcatccctcttaatcagctcacggtattcctctacagtatatccggacagttccggaacaccgtctgaaaaatatacggtctcaaaaatatcagacaccctgtaaattgcaacaccgccggaaatggcattgacgatatcttttaccttatccttttccgctgtgagttccctctccatctgcacctgtccgctcacatctctgtaaacaccgtacagcagcttagtcttatccgtctgggtttttacagatgcctgcagatggatccagcggtattcttctttccggtcattccaaacccggtaggtatgctccatggttccgctggtgcttatagttctctgtattttttcctggagaacaccgcagtcctgaggatggactcccatatattctgttttttcctctatgatcctgatgtgttcttccgaatagcccatgatttcataaaaagcagggttatgaaagacaggggaaatctgttcaccgtcatagcggtatacgcaaagtccgcagggaatgctgctgaatgtggcctgaagctctttttggagcacatctgactgctcttcttcccgcttcctgtccgtaatatcctgtatatattcaatatgtgcggcctttccgtcccaatcgatcattttgccgctaagctgatagaccctgccgctgacaggatgatgatactcgcggagcagcagatccggtctgtttatttccttcctgcggcaaaacgcacacggtttatcaaaccctgccacccgataacaatatttttctgccaaatccgcatccggcataaatgtctcacatgccaggcggttggcgtacagtatctcatatgtatctgccgaactgacacagacagccaccggtgcattatccatcaataccttcacctggtccgcagaaagagaaacctcccgtatcatgacttgccctcccttacatatatattcataaaactctttccgtaatgccggtctaggtataaaaaaagggccggccctgcgcgttatgtgccaaggaacagccgcaccgctctacagaaatagtttgattcttcaaccacttgattctcaaacttcttacttttttgcaatattttataaattggtcagaatattatattttttttacttatttcttctaattttaacacagagagtctaaatgcgcaatctttttgaaaaacccccagatactgaaaacacctaagaaaagtatctggtatcgtaatgatcgacccggctgaaaatgcagacaaaacttaaaaaccagccggagaaacctccggctggctggtcatattgtattatgtatttttcacaattctttttaatcccactctgacgcaaacctgtcatgcaccgctctcatagccatctctgcttctgcttcctttatcaccgctgtaatacggatctcagaagttgtcaccatatctgtattgatccccgcgtttgacagcgcctcgaacatctttgcagccacaccgggattggagcttacccctgcgcctaccacggaaactttagccacatcttcttcacagcttacattggcattaccgatcacatcactgtattttttcagaagttccagagtcatcatcatatcaggccttgccacggtgaacgtcaatgtttttgtaccgtctttttccagagattggatcatgacatcaatatttaccccattctttgccatgagattcagaagtctgaatgtactctccgggttatctttcataccggaaactgcgatcttcgctatatttttatcgacagccacaccgcttatcagcattttttccatctttgtcgtctcctttaccactgttccttcttcttcactcatgctggactttaccaccagatttacattgtaccgccttgccatctccacacagcggctgtgcagcacttttgctcccagggaagcaaactccagcatttcctcataggtcacctcaggcatcttcctggcatccggaacaatacggggatcagccgtatatacgccgtccacatccgtataaatctcacataaatccgcattcagcgcagccgccagcgccaccgctgtggtgtcggaaccgcctctgcccagagttgtcacatcgtcatatttgttcacgccctggaaaccagtgacaacaacgatcttgttagaatccagctccttggtgatcctctcggaatcaatcctctttaactttgcgttctggtacgcagaggttgtgtgcatgggcacctgccacgcattcagggaaatggctgtcactcccatctggatcatggtcattgccataagggatacggacacctgttctcctgtcgccaaaagcatatccatctcccgcctggacggcatactgctgatctcccctgcctgggcaagcaggcggtccgtagtctttcccattgcggagagcactactaccacctggttgccctctctccattttttaatacagcgctctgccacatttctgatcttatccagatcagccacagaactgccgccgaatttcattactacaagcatgatgttctcctattccttttgtaccttaaatgctgtcatccgtacagatataaaccctatccgccggaagaaaattctatctcattataacactatccctgcgtatccgcgacaatatatttttcggatgccgccgcaaaataaactgtgttttcatagcaggtcgtccttatagctgcctgtcaaaatactgcagtgcagataattctaagatattgcgaaacgcaataaatagtatggcataaatactgacacggttcaaactaaaagtcagctgcacatcaagatgtgttacgactgcatccacaacgatcaaaaacacgatcaatagatagtttgagaagttggccgccctgtttgctttgttctgaacagcctcccagcgctcatcacctctgtattctatctgctttttggccttccaaaagtaaagaaacagcgttgctgcagtgccaataataaggaaaaacaaaataacagcctgctcatccatactcactcccccttatctcccttatactcaaaaacttcatcgatgggtacctgaaaaacttctgcgattttgaaagccagttccagagaaggcgtatatttatatttctcgatggatataaccgcctgacgtgatatccccactttgtctgccaaatcagcctgggtccagtcccgttctgctctcaaaaccttgatgcgattctttatcaaggtattaacctccttacaatatgtaacctgttggttacattccaattgtaattggttgattacattttgtcaagtatgtaaaacatacaaaacgtccaaatcaatgccataattactgagagactcaggtaaatcgtttcttaaataaatgtgaacgcaaaaaaaggataccactcccataacaggatgatatcctttttcccggtactggcaagaagggctatctaaattttacgctgtcgatcaatgcctgaatattctctttcggagtatctcctcccagagcgcagcccggtcccagtataaaccctgtagtagactttccaccaacgatctgcaggatccgctctgctgcctccttcacttcctgctgtgtgccgtttgaaagcagtacaggatttacctggccaagcagagcgcagttttcttttgccgcccggactgctgtctttaaatctgttttctggtcaatttccaatacatccgcacccagattacacatctgatctatgatctttgttgcattgccgcagatatgaagggaaatcaggcctccttttctgtgcactgcctctatcacctttttttcataaggaacggcaaaggtctcatacattgccggcgagatcacatccggccctgctgtgctgtcgcccatggatgtcatgggaacgcccagttgaagcagtttttcatggtatgcgatacatgctgaggtacagaactcaagcagtctgtgaacatcctcctccgcctcttcgtccatcagatcctccagcagccggtccatgccatagagctgggatgccaggctgaacggtccctggtctccccgtccgatcaggaatacctccctgccgaaatgctgcaccagcctctccacagtcaaaatctgggcttttaaaagaggactttcccagaaatccgccggcatcttaagattcctgatatcttccaactgtttgaccgcagtggtatgtgccaccggagcgccttttttcctgtagatcacaccacaaccaagggcctgtgccagcgctgccgttccattttcaatcaggagcatatcgtgtccgaattcttcccacatatttatctgcatttcagccatggcactgtcatccagcacaaacgctccgaaatccattcccgactcctctgcgcacataagaaaattatgcaggtctgtgggcattctgtccacatctctgaattgaatggcagccagacaccgttcgtatgaattcatatattctttcatatggatgcctcctgtccgttctgtatctccttgatctttaataccagaagaccgccccggctggtcttatctctcttgatgagccatttacggcgggacaggtgttttccgctccaaaccacttctcccatctcttccggcgtctctccgaacaggacagatacctgataactgttttccggttgaagtacctctgatagatccggctttatccaaacattcttttcttcatcaggattggctgcgatcaaaagaacctcttctttttccctgtaaatgtacggaacgggaagtatctcatctgcctcataatccaaggggcagaaacgttctgtctcttctcccattcttcccggccgtatgagatggggatgcgctctgcggatttttatgatacgcttcatatcctccagcatttccgctttttccgggtttttcagttgctcccaatcaatccagctgccatacagccaacgcccttttcccggttctccctccccgtataggccgggggtaagctgaggcagaggacggtagtccgcatcgaattcctcccctgccataaacacagggattcccggagccagaagcgttgtgtatccggccaggtaacggcttccctgtgcagtatatggattttctttctcaggaaatccaacccagccattgtcatgacaactcagttggatggatatatactggccatcctggaccctgaatggaaactctacgttcagcccgtttttgatcctggtatattccaccgtatagtccacttccaaaacatcttcccggctgctgttccagacctgcccagccttatccgtcacctgaatgttcttaatccttttatcctcatggatattctcaacacgaatcctgcccatctgaatgcgataagctgcacggccatctgcacacacaatttcctttttcacgtctccttcaaaaatcacttccggtactttgtcctttccaaaccacgaactgtccctgctgtcctggatggttccgtcttcgtaaaatatcttcacattataccgctcatttgctcttatctgcctgtctctgcagtagccggccggatcacagagcattctgaaggaacggttcaggccatggttgtggcctacagcctcaccatgctgtaagatatctgtcacgccgcagatggcaggtcctgtctcggcaatgatcaggatcttctttcccatatcggctgcttttctgcggatcagtgaccatagatcattgcgataatgtgcaacatccagccgatatccgtcgattccaaattcctttatgtaccatagccatgtatccacccaccatgcatccatatccgcgtgtccgccataccagtcaaaatcgcgcatcccccaggagcctcccagaaaccaatccggatgttcttttacaattgggctgtcctccataacgccatgggttattacgtccagaaaaattttgatgccacggctatgggccttctctattaaatgcctgaattccgcttctgtccccagccccggatctatacaatccggacggatacacgcgtattctgtccagatattatagaagtgacttttgtcacagagctgatgtccggtaagccacacagcattgatccccagttcttccagatacggaagtctctcttccatagaagcaaatgtacctgactccggaccgttcggtgaagtaaaactttttgtcgcaatttcgtaaataataagccgttccagataatccggcgcatctatgatctgatagtccataacatttccctttcttttatattaaaacatgtctctcatcccttgacggagcctgcgaccatactctctgcaatctgctcctgcaggatcacatagacgatcactgtaggcaggatacacattacaagcgccgcaaacattgatgaatagttgaagctgaatgtcgatgtaaaatacttgatagtcagcggcagtgttctgttcttttcactggaggtgagaagcatggcgtacatgaactcattccatgagaaaataaaggtaaggatggcagaacttgccatagccgatttactgagcggcagcatgatcttggtaaaggttttcaaaaacccggcgccatccatataggctgcctcttccagctcctttggcactgacaggaaaaaatttttcataagaaacagactgagcgccattccaaatccagtatagataagaataagccccgccttcgtgtcgtacagtcccagcttattgatcacaaaataaaccggctgtaccatggcattggatgggatcagcatggaagagatcagcaccataaagatcaccttcttccctttaaattctgttcttgccagcacataccctgccatagagtaaagcactacagccagaactgtgctgatcccggccacaaataaagaggtgaaaaaccgtgagataatgtccaccttctccaatgcgatcctgtaaccatccgtataaaatgaagtcggcagagaaaagctggaagaaaggatctgactgtttgtcttaaaggaagacaacaaaacccataaaaaaggaaacagcgagattaggatcacaatccccataataacgtaatcaaatatccgctgtcctgtctgttttttacctttcatacttctccacctctcaatctgcactgtccatacgaaacaatttattacagagcaacataacaacaatccccaggaccagtaaaagaattccaagtgtattagcataaccatactgattactctgaatgatcttgttcaccatcatgacagaaatcgtcatactggaatcccctggacctccatttgtagtcatataaatagactcaaattctttgaacacagatgtgaccgccacaatcgcacctgttccgatcgctcttctaagcagaggaaggtatatataccaatccacctgttttgctgttgctccgtcaatcctggcggcgtcctctatttccgaagaaatagagctgagttccgccaaaacgatcaacgtgataaccgcagcataccaaagccaaatatttgtgacacttaaaaatgctgtttgagaatccaccagccagtttctggtcaaatgttctaatcctacactttttaacagcatattcaggattcccatatccggcttatagataaatacaaacatcagcgccagcgcagatcttgaaataatattaggaagcatgaataccgacctggtaaatctccagcctctcctctttctttttaagacgagcgccactaatacaccgaaaggaacatgcacagccacagccaaaaatgcccagaacagagtatgccaaagagatgcatgaaacacggaatccctgaaaatctttacatagttttccagaccgataaaacgcatactctgcattccgtcccatttggtaaaactggacaccagagccagaatcataggcccaagatagaccagagcaaacattaccagtgtaggagccaaaaaaataacgatccagactttatttttctgtttcatctcaatcacccgctgtctattctatatcctgtttatactgtgcagcaccttcattcatcatctggataaactcttccacagtaatgctgcctgataccagatttggaatttcccttccaaatacatcattctgggaaacagggtcccattttgtctgatagcttggcagaacaatactcacatcggaggaggcatctacacaatttttcataggaggaatcatcttatcatattcgtcctgtgggaaatccactacagaagacaattcccctgcctcaaccgctcttttggaactatatactggttttgtataaaatttcataaattcaactgcaccgtcaatgacatcctggccgtaatccgtggtaatacaccagcttgactgctccatagaaccaatcattacatcccccgggtactttgcatagcctactttatccgcgaatccctcagaggcataatccgggtccgttagacttgacatcatccatggaccgttggctatcattgctgtatttccgctaaagaaattatttgctgccagtgcataagttccgcccaccgcatcagatgtggtgtaatcaaactgtctttttagaacctccactgcctccttaaattccggagtatcaaaattatccgggaactgctgtgccataaacttctgcccttcctctgttcctcccagataagcagtggcgagaagcatgggacaccaggctgtctctgtggtatggagggacaatgccggtattcccgcttcttttaactgttcacaagccttccaaaaatcctcccaggtctcagggaatgtctcgatacctgcctgttcaaacagctctttattatagtaaaatcctgagagctgaagacccgcacttggaatcagatacattttaccgtcatctcttgtaaaggcttcgattccctgaggcatcaactgccccttccattcctgatccgcttccaggtaaggtgccacatccaccaatctgccattttccacaagcaaatcataaaatgctggttccggcccaacctgaatcaatgccggcagagaattagaagcattcagcattttcagttttgaacgatagtcatcagatgctcctgcaagatattccacatccatctgatattttcctttgtactcctcattaaaatcttccactacctctttcatctgaatgtccatagcgtcattggcgccggttgtgataataattggaattttcacttcctcttcaccttcgcctgatgtctgactttcagaaacagaatccttaccttccccggtatcctgagtattgtctttgctgtttcctcctccgcatccggccagcataaatgctgcggccaaacttaaaatcctcatcatatttttccttttcattaacaggaacccccttttcttttgatgactgtattatagcaatcttcggccttcaatatatacaaaaaaatatatctgtattgttgttttctatacattttaattttatttacccatacaaaacagagttctactgtcattttgtgtgtttaccgcaaaaaaggcgcagaacaaacagcactttgccctgcacctcacttatttatttttctaattgttttgtatctccaaatatactttggcataacggttcatggatgcagtcagacccccttttctatgggaaggcgaatcatgcagactgtccccgtctcctttgtacttttataagagatcctgaatttgtctccataccgcaggcagagtctgcataccacattcgatataccatatccgcctcttttctggggaaacgtctttcttatctgctccattccctgatactgcatctgattaagtttttccagaacttcagtctctataacacttccattatttttaacacacagttctataaagccttccatgctcctggccgtcacctttatttttccgccgtcatccatataggcaaagccgtatttaatgctgttttccacaacaggctgaagaatgatctttgggatcaccgcctgttgtacagcctcatctgcttcaatctcatactcaaacaggttctcatttctaatctgctctatgtccagatagcacctaacatgttccagttcctttctcagcggcacatcattttcccctttgctgatactgatacgcagcatattggacaatgactggatcagccgtaccattatctcatccccatccatcctcgccagcatatggatattatccagtgtattataaagaaaatgtgggttgatctgatagacaagggaattgtattcattgatacgtatttcttcctgttcttttttcacttcctccatcagacttcctatatgcttgagcattttattataagaaactgccacttggtccagttctgtattggtactgatctgtatctcctgatttagactctccccatcaaaattactcatgatccggctgataccggaaatcgcttttctgaatggatgtgatacaaatgcagatatgacaatgcagagaataacggataccatcattgtcactcctaaacttttcaaaaagctaacagccggagcctgaattacggattttggaaccactgaaagaaaaataaaatcctgatccttatccgtattgacaaaacaaatctggctgtccgcagcaaagtggaccacctcacctgcttcccggggcagtttttcttttgccttacgcaaaatttctatgctgatttctccatcctgttccactccccctgtctggcagcatatttccccctctatagtagccattgcatataccgcaggggatttctggttcacatcaaaaaatatattgttatagaaatcctggttcagtttgatgatcagaattcccggacttacattttgttccatatgccggatattgcggactagaaatattcctgagtccttctgtccgtttatcagaactgtactgtacataattctggtcagggaataattatcagcaagtgccctgctcagctctgtggacaggatatcttccggatttacgtctgtgatcactttatttgcaaagtattcatttcctttgttgtctagaaatatcccgtattccgcatattgattgttagaataccagagacttctgtttacatatgctttgtcctgaggcagcagttctttcctctccagggatttctggatataggaattggtgatataatttctggtcagttcatcaaacccctgtaccatcatctgataatttccgatcattttgctgttgctgtgggaataattctccaggtttaagtccgtcacatttctgtttatggaaccggccaggaccaaccccataataccaaggggcagaatggctgccagaattgtaaagatgaccagctttttgcgaattccgtaaaaccttttacttttcttcatacattttcttcctgtactctgttggcagacatcccgcgtgtttcttaaactgctgcgtaaaataggaaggattgggtattccaactttctcacagatttccgttatggagtcatccgttgtctttaagagtttcttggccaatctgatcctctcttccagcagatattgtttaaatgagcgctgcatactctgcccaaaaagccggccaaagtataccggatttaaatgcacttctcttgccgccatgcctacacttaaaaattcatcatccagatgctcctgtacatagctgacagcctgactgatgtaagttctggcatgactgcggatctggtccaattctgtcatatccctctttttaccgtccgcctgttcgagattttccactgcctgtacataggcttcctttaatccttttatccctctgcctgttcctgatatgccatatcgtaactctaaagaaaacttctgtttcagcagctccatctctctttctaagactggaagtaccaggtactcttccctagaagctgataagatcataatcctgtagccgctctcattctggaaataaaaatactggtaagcttcccctaaatcatgttctaaaaatccggcgatttcttcctgagtcactgactgtctgtttttctcatcaaagactctcacaaagtccatacagacagcccggtaaaagaaagcatcccgattttttccaccaaagcgttccagcgcttcctgcagttcttcctcgtctatctggtctccgctgaatttccccaccatataattctcaaaaacttttttgttattttctatgaaatgttcatagtcctgaaggattctgctgcttttccttgtctgccggatcgtctttgcagcgctttgaacagcctcctccagcttactgtcctctatgggtttcaaaagatatgtaaacgccccaagttcacatgctttctgcgcatattcaaaatcccggtatgcgctgataacaatccataagcatttcttttcagcccgcccgttcacctcctgaatcaggtcaagaccagtcatttgcttcattcggatatctgttatgacaatatccggccgcttttccagaatttcatctacggccttcctgggatttcgtgatgtacccactaccactgcccccattttatcccaggaatatgtagtctccagtccctttaggatgatcgcctcatcatccaccaaaaaaattttaatcttctccatttctccgccccgtaattgttagagtgtgtttcatcataagtttcaaaccctctgcagaggaatacaccttgtgcaatgaattaattataccccggaaaacggagttttggtagtctcaatctctgtcctatatttttcgtctacctgtttttggccttcatccgtgggaatcacatgtaaacagacagtatggtaaaaatataccccctgtcaaaagacagagggcatatgaaaatgatatttatttttttctgtactttaaaaaaaggatttatatcttattggtaaatcttttataatagtgctctgctctgtctttatccagcagaaagtgcctctgcattttttctatgataatatttttatctgcattctcttcttctttttcagcaataaatgcttttatcccttgttccaatccttgttccatcccctctttaaccccttcttcataacttagttttttctcatttttaatatgacgctctgcattatattctgtcaatatcacatccttcacctctcctcgctgtttcttcaggaaatccgcaagaatatcctgctcgatacattttcccactacctcatccaccatattttctaaattctaaggatacattttcagatacagccgtacctaacaaacatttataaaatattaagatatgcatatttttttacaaatttcccctttataaccctgccaagtcatatgatctggcataaaatccttcatttcctatttttacaaatccatttttctcaatcacttgaatcatagttttcatcatctcgtcatcagtaatatttttccaggtcaccgggttctgaggctgtggataaatgcatagacatcgtacactaatattcagagaatatttcaaaagtttatggatactggaaaacaaatattttgctatccccttgtgcctatattcttcatagacataaaatgttgctatgtatcctgaataagagtcttcccaaatccattcatccccgccatcatctctataaccttcaaattgagaaagccagtaggcagcactgttttcatcctgcgctatataatctgccgcttccacaatgtccagtccgcattcttccaacttattttcatcaaaaagagttccctttataatagccacttcctgcccttcttccacaaaactctgatcaaaaaattcaagctccattctttttcttcatatatattattttctactgactctgtaaaatcaaaatattctaagactccccggcttgatgtaatctcaattctatatctatcttcttcatttcccacataatattccataaaatctccatttctctgcaaagtcaacggcacagatagaaactaaaggcactacaatgacataaatcatgctttcttaagctgaagttgtttagtcatataaccgcacactataacgaatgcatattcgcctgtcaaggcagcatatgtattacttctgtaccaactagagtaatatagttgaaaagtcaatacatttgaatacatttataaccccttagcaaatcttttataatagtgctctgctctgtctttatccagcagaaagtgcctctgcattttttctatgataatatttttatctgcattctcttcttctttttcagcaataaatgcttttatcccttgttccatcccctctttgactccttcttcataacttagttttttctcatttttaatatgacgctctgcattatattctgtcaatatcacatccttcacctctcctcgctgtttcttcaggaaatccgcaagaatatcttcctcaatgcattcttccaccgccatgtccaccgcaccttctaaattctcaggatacctttccagatacagccgtacctttgacacaaagaatgcatattgccacagcagactgcagttttccattaactgccggttatgtcctgtattgatgttcaggaccgtagccacacattccaggcaatagctgtcctgcttcctctcaaatgcgtcactgagccggtactcccggcgatccggttcttcctgcgaaccattgtaaaacacaatatactgcggcaacggaatttttatacgacttccggaataaatatcaagttctcttttttccacatatccctgatatacccttgcaaaatatatcaagccccgcagaggcatattgggatttctggtagattgggcttcatataaattcatcacactgtcgatcaaaaaggataggtcgttcttgactcccatataaatagccccttcaatcgtggtgatctccaattgctcaggattttgataattggaatgattgatggcattataaagttccagtgcagcttttctgtttccgaatatcatacggaacagactatccttgtaatttctgtttacctgtttctttctgagcgctctgcttttactttttcttctgtttctgttcatcctgcctcaactttccgaagcagctataagcctcaggaatctgtaaatattatatcagaaataaacctgcaccacaacttgctgcttctatactttacttatttaactgttttactctgagaattccggcagatactgccgatttgatgaaaatagaaaaaagataactgttcagtaccctcacagttacaaaaaagattcttttagaaaatcattgattacagtatatcagatataaagcgctgctgcaatcatataataaaatttacaatccccatatacaaaatccggccgtattttaaaagtcccccatttcttctggaaataagcaatttccagccctttgaggctgatggcttcatcatccaccctgcatagagagatatctctgtgcgcagaatttattttaaagtaaaaagaactgtatgaatattaataatctcttaaatcaaaatccttacatatttgtatcactaaaatactgcccacctgtagcactattcttttacaaatcataaactatatataaaaaggaaaaaagaaataatcatatgaatttttatgactgtccttgtggttgtataaagccttgtgaatcctattcctacgcacaatatgccatacaagctaatccaccgtccagatctgaccttccaatgtttgtattgtttcaggaaggtaaacggatttctttatcggacacgaaaatatttcttgaaccgggatatctttatcttatagattttatatttctggctacgccggaaacagacagttttatgcagatcactccaaaaatcaatggggtccttaaactgttgtattccttttttgcccccactggttccgcatcacgtaatacttcagcctccggtagttttacggttccagtaatgggagacagcgcaaatgtttcttttaatctgacgtatccggataaggttaaaaatattgatatatccggcgctgtgtctgtgactatgcttcataagattaaaaactgcagcactgtccggccggatgtctccatacaaaattcctgaaagctcccaaatctgccgccggcacaatagggcaaaggagtttaaatggacaaatgaggtgcactgcctatcaaaagcagaaaaacaccctgtactctgtccggcacccggacttactatttttatattgtaaatatatggacaatttgatatactttatgaaataccgggtgagcacctaccgtatacaaggctatatcttgtatacggtttttgttttgggggaatgtttgatgaggaacagagagaaaagtaaaacagaaaatacagcaatcacattgatcagattttgtgtgcctcttattttaagcagtatactgcagcagctctataactgggttgatgcatttatcgtgggaaatgtagcgggagaaaaagcgcttgcggctattggttctacaggtaccattgttgatttatttctcaatgccattacgggatttacccttggactttgtattttgtttgcgcaaaagtacggcgcaggcaaaaaagcccacattaccaaaatactttccgtgttttctgttatcctaggcggtatttttttgctcatctcactgatcggtattgccggcgcgtatcctctgcttcgtatcatgaatacaacaccggataccatttatatggcaaaagattatctgcagataatactgatcggaatcccttttcttgctgtatataacgtctattcctcagcgcttcgcggaatcggaaacagccgtgcaccttttgtgtctgttttattttcatctgttgtaaatataatactggaccttgtttttgtaagtgtctggcactggggtgttgtgggcgcggcaattgcgactgtgatatcacaggcttttatgacaatatttatcattctatatagtataaagaagcattcctgcctgcgtttttctgtaaagaagtgggcactggatcactccgttttgaaagaggggcttcgtttaggaatccctcctatgatccaatccagcatcacatcactgggagggcttatattacaaaatttcatgaacggattcggaacacagaccgttgcagcgatcaccacagcatatcgggtggatactatggtgcttctgccaatcgttaatcttggttccggaatctctacaattgtggcacagaattatggcgcaggaagaaaaaaacagattccaaaaatcgtctgcgttggcacttccatgatgttttgtatttccttattgttgacgtggctgatcgtggagaccggcggatatctgatcgctatgtttggagtaagtccggaggtaacagagattggaaagaattattttcagacaattgccgttttctatgctgtttttggcattgcagcatcggtacggggctacatagaaggaatcggagatatactgttttccagctttgcaggtatcatttccttgatttcacggatcatattttcttatgcttttgttgggatttgcggaaatatgatcattgcatatgccgaggcgggttcctggggtgtcttattagtgctttacaccatacatattctaagaaagaagttcctttcaaaaaatatggatcagatagtttgacagcctttaataggtgtgccggcctccccatacgcgatgctgttctttggtaagaagcttccgactaatactgcaaaaaacagttatcaaaagctccttacccgggtcttatagtgctttactacatcatacattcccgatcaaagcggttcagacaggtgtatcagcgtgtagagcagttttgggcagggattaaacttactctccctgcccaaaactgctttctgttatcttgtcaaatccaaatataataaaaactgaacctcctctgccgcatctttgtccccataatatgcataccggttgagagcacctaaatgagcaccctgtcggaaataaaaatccactgccggaacattgttattctgacattcaattttgagctggttaagtcccagttctatggcttttgtttttaccatacaaaacagttttccgcccacaccgcgtcttttataggaagaatccacacggatatcccacagaacccccagatcttcccggccttgcaacatatgaagctccgcagaatggctgcacaacacagcccctcccactggcttctccccatcaaaggccatgaaaaaatgccaatttgacagatcaaactgctgattccaccttttaaaattggcatcaccggaaaaatcttttacatatggcactgtatctcttttttgaaacgtgatgccgctcaaatcttttatttccacttcatatatttccttgacaggaaccttcatttcaactttatcataaatacaggcatctgttttccttaattctgtatattgaatttctcgactctgttccatatgatcctcctattgcagtccttctgtacctaatcacctttggtgatgagctttctgcttgtccgccaacattttcctgtgatcagcgcagtaactgcgcaggcctacagaatagtcatcatatattttaacataaaaccgccgtgttttacagcatagctgtcaattatcatctacttctggacaagtgacaaaccggctgatacaatgattttatatgaaaaggagggatccgtatgtgtggaagtaagaatgttttctagatgatcgcttataaaaacggaggtatttatggaatatattatcagagagatgtacccacaggaatatccgctccttgcagaatttttgtatgagtctattttccagcgggaaggggaagaactgcttcccaggactataatcagccagcctgatctgcaggtctatattcaggatttcggtaccctgaaagatgatgcctgtctgtgcgcagaggctgacgaacgggtggttggcgcagtctgggtaaggaatatccatggctacggagatttagatgacgagacacctgaatttgccatatcccttttcaaagagtataggggatgcggcatcggtacagaacttatgaaacagatgcttgaattattaagaaacaagggatataaaagagcttccctgtctgtacaaaaagataattatgcgctgcatatgtatcaaaaagtcggatttaagccagtcattgacaaagatgaagagttcattatggaataccggttctgagaggttgcattttagaggctgcacacgatctcccgtgtgcagcctgctgcgtatccgcaaaacttgatcactctctttactctgctgccctttagggtcaggacgtttcattcctgctttcgccatgataggtattacctcctggttttattattgacagaaaaagagttacatgcctgtaaaaaaatcctgatattattttcttcctcttttctcctgctgcccgctctccccaatctatcacacagtcccagcagtgccacctcatttatatctgtatgttgtttcattccctcaatatctgcaaaacgaaggccgtttaccacatacaaaatctgcatatgatatcggatcaactgtgaaacctcatcaataaacgcctgttccttcgcaaactgagtgagaaattcacatgccagaactgcgcccactttatcatggtcatacgctgtgatttttccatttctgtttcttgtttttcttgcttttccaatgtcatgaagcatagctgcccacataaaagctaaaggatttttgctcttgtttcttactcttgccgcctcatttacaacaagaagtgtatgattccatacgtttccttccggatgatatttaggggattgctcaacgcttttcaacttatgcagcatatcaaacggatacttctgaaaatccggatcctcatagatttcattcagataacaggatggctgtatatctttcattaaatgatactccatattctggtagagttcccatcggcttttattcctatcagtcatgtattttccacctctcagtcagtattccactggatcaaatctttattcgtaactatccaggctcttcaggagcgcaggcaaaatttcatggggaaccgccattgacaacggaacttttgtcgaactactgcatcaatcactgtcaaaagcatttcaccaaatttacacactttctcctcaattttatcacagaatcacgacaatttcgccacaattatccgatatgctatagacataaacaaagagataccaaatacaaacacaccaaataaataataaatgcaaattgaggaggaattcttatgtcaaactattacgattttaattcagataacaacaacaatgaactgtcccattacccggtcttttctgaaggctccgcatcatctccggatcctgacaaaaagccttccaagcacagcaaaagcaaaaagaaaagccttgcaaaacggattggttccctgactcttagtgctgttctgttcggttctgtggcggctggttcttttcaggcagtaaatcatatttacacagccaattcttcatcagcctctgcaaaatcagcttccgagagcagtgattcaaaggcaagccttttgaaaacaacagcggtttcccaaggctcaggcagcaatacaggaagtatggacgtatcttctattgcagcggcagccatgccgtccattgtctccataaccaataaatcggtccaggaggttcagaattatttcagtcagtttggatacggtggttatccgcagactcaggaaacagaaagccagggttccggtatcatcataggaaaaaatgacacagagcttttgatcgtgacaaacaatcacgttgtggaaggcgcggataccctttccgcatgttttattgacaataatgtactggaagcaaaggtaaaaggaactgacgctgacaacgatttagcagttatcgccgttcctctggacagcatctccgatgaaaccatgtcagctatcgcggtcgccaatatcggtgattctgactccctgaaggtaggcgagcaggttgtggctatcggcaatgcactgggctatggtcagtccgtcacaacaggtatcgtaagtgctgtgaaccgtactctatccgaaacttcttcagcggctgatacaaacacagacgactccaacgctgctacttacatccagacagacgcagctatcaaccccggaaacagcggaggtgcactactcaatatgaatggtgaagtcattgggatcaactctgcaaaactggcatccacagcagtggaaggcatgggctacgcaattccaatgtcaagagcatctgatattatagaaaacctgatgaacaaaacaacccgtgaaaaagttgctgagggtgaccagggaagtctgggaatcaagggtgcagatgtaacaagtgaggctgaggaaatatacggtcttccaaaaggtgtatatatctcatctgtcaccgccggaagcgcagcagaaaaagccggcatcacctccggcagtgtcctgacaaaatttgacggtgaatccatcaccgcagccagccagctccagaatctgctccagtattacaaggcgggcgaaaccgtggatgtaacactgcaggttcccggtcagaacaacagttatgaagaaaaaactatctctgtcactcttggtaacagcacagattcgggaaacagccagaaagataattctccatctccggcgatgaataatttccgctgatgatatcggctcacgtcatagaaagcaagcaggccgcggtatctataaaaccgcggcctgtttgcttttatattcccggaacatccggtaagtctaaaaattcgacacatatatatacgcgtcttccaacgtcacctttgcctgactgcacggcacatccggttttaccgggctgatcacacggacggtcatgccatcctcctgaatctgtttagatgaaacatggtatttctgttccaacaggcgcacctgctgctcctcttgtgtttcgcaaatccagacatgaccttctgccaatttcagcagttctttcacggaaccgctgtaaagcatttttccctttttgagcacagtcagccggctgcaggttgctgccaaatcctctaccacatgtgtggaaaataaaaccgttcttcccaccgcaaactccaccagaagatttctgatacgtatcctctcctccgggtcaagcccggttgtcggctcatccacaataagaaactccggttcatttagaagtgcctggatcaggccaactctccgcttcataccaccggacagatgtttcattttctttttctgatgttcctccaaactggtcattttcagataatgatccactctttgtctgcattcccctttcggtataccggacagttcccccagatactccaggcattcccgaactgtcagattaggatacagggaaagctcctgtggcagatatccgatctttttctgtatgaaaggataattgctctcccgatacaccatattatttatcataacatcccccgccgatggctttaacaacgttgccagtacccgcataagtgttgtctttcctgccccgttctctcctaaaagaccatatacgccggatggaatagtaaatgaaatatcgtccaatacctttacatccttttgaaatctgactgtaacattttctatcttaactgacatatcttcacctttttcctttcttccctgcttttcccgcatatccgccaaaatttcccaatgcccccatacagacacctccaagaatcagtgccgttacctttccggttatccaccacagctccccttcctccatattcctgctgccaaatgcaaatatctggaagaaagggggcagcttttcagcccagcttgatataagaaaaaaccaaagcgccgctgatgccccgattgctccccaaaggctgccggtcattttggagagaagcgccgaaacagctccgaataaaacaacactggctgctgacgcccccatagcggccgcaaaataataaaaccctttttctcttatatatggctgctgtataatgtaaaacaatccataccctgccgctgccacacatattataaataaatactggacagcaaagcgtctgaggatggtcttcctctgctgcattttaggctttattgcaagaatctcccaacctccccccggtacctcctggtaacaggtatctgcgcacaggacaagggcaagaatcgctatataagtgtcgatcgtcggcccgatctcatttacatccgtgacgccccttactattgccaggatcaggacaaagaaaaaggcgcagaggattttatacaatggcaggcttattttaatctctttcacccgtaaaccctcctttttttccataatttcacacatatccatatgattcccgccgacacaaaaagaagcacggtctggttcatgagggcaagcggcggcggtgcagtatccagaaacagccctggaaaacgtaccatgatagcaagaggccttccgtaataaccatatgttccgtccggtccgatactgcccatattagaataaaccatataaaggatgagcagcggggcagccggcaggggatttttaaaaagaagggcggtcagggcatatacgcagatcaccataagcaggtttggcaggatataaagtacatccgctgcaaataaatcccacacagctacgggaaatccctgttctattccgtttttcatacataaaaatgtaaaaacagcggtcatagcagcaagcggcagtaaaagtgctgtaaaacctcccacgattttccctgtcacatatttccaggccgataccggctttgtgtgaagcagttcatacatattcttccttgtatcctgaagaaataaaaatgccatcaaaactgaggagaaaaagacaaaaaacagtcctgcaaaatcagcaaattttctgcccacatattccgaataccgcatactggtgaattttttgtctatatatgcattcacttcttctgcagttccctgtctgagttctgcctcctggaaatagtaatccaccttaatatagtcgtaatgcttcatcagataatccatgatttctttttcgctgtatccgtctttctgaaaaagttctgccatcttatccgtttcctctttgctgactcctaatgccttgttcatatctctgcagatttccggcagggcaatttcaatccgttccttctctgtcgaaggcagatacccattcatcacatccgcatcgttgatatgtttcagtttggccgcctcaacctgtgcatcattttcccagtaatgcagcttcagataaggctgaagtatctgaaatacttcaaaaaatatcagcagaatacccacataatagatggggtttttgaaatagcttttcaattctcttttgatgataaccttcatattgcattcctcctgttctgatactattgtaaatgagaaatcacaacaaaaagacaacaaaaaaagaactgtcagttgatccataccaataaacagaaaactacagctcgtatttccatttattgatattgatcttccgacagctcttttattctgcctccaatactcagccattcagcttgtgtgcaaaatcagccatggcttctgatatcttaatttgctgcggacagactgcctcacagctttggcatccgatacatgcaccgggctgtttctcctccgggacggcctgcagagccataggcgcaataaatccgccgcctgtaaaacagtgctcattatacagctccagaagcatgggaatatccagttcctgagggcagtggctcgtgcagtaacggcatgctgtacagggcagggcaatgtgctttaccatgttgtcagcaatctccagcagagctgttttctcctgctcattcagaggcttatccgtctcaaaagtatgtatattatcctgcatctgtgcaaaatcagacatgcctgacaggatcatcttcacttccgggattccctgaaggaaacgaaaagcccatgccggattgccctcgtccggacgaaatgtctttaatttttcactgttttcctcggacagagaggcaaggcgtcctcctctgagcggctccattacccatacgggaatgtggtattcactcagcaggtccactttttcttttgcattctggaaggaccagtcaagatagtttaactgaatctggcagaattccatctgctctccgtaagcctctaaaaaacgtttcatcacatcataacttccatgagcggaaaagcctagatgatgtatccttcccttttccttctgtttcatcagatagtcaaaaatgccatatttctcatccaggtacgcgtcaatgttcatctcacatacattgtggaacagatagaaatcaaaatactccactttgcatttctccaactgtttttcaaaaatttcttccactttatccatattggagagatcataccccggaaatttagttgcaagataataggtactgcgggggtattgatccaagatcctgcccataacggtttctgaattcccctcatggtacccccaggctgtgtcgtaataatttattccatgttccatggcgtatgccaccatctctgcggctgccttctcatcaatcctggaatcttctccgtttatgaccggaagacgcatagctcccattcccaacgcagataatttcatgtcctgaaaattcttatagatcattttgtccgctcccttcttatactgatcattactattttaaatcattctcatgcatagcacaaatacttataaaatatggatttccataacccgcagctatagtgtcccgtcgggatgcggctattctatgtgaaatcccgccttcacataagcccctcccaaatcagcactgcccaacagcagtttacctccatgcatctcgcagtacagtttactcagatacattccgaggccaaaatgcttcaggtcatctgcaaggttatcatggtagaagggtttcgtgatctctttttctttcccatgaaatccctccccgtcatcccccatggaaataaaaagcattccgtctgtcacctccatagtaatgaggatcatatgccgggcataccgcactgcatttcccagaagattctcatacacctcacatatcaaggaaaaatcaccaaaaaagccatttggcattccctccgatcttatgacggttcggcaggattccttgttggccagagcctttgccgtctgttccatgtatctgagcaatgcagaggtctctatcttatccatatgaaccgttctctcttcgatgccggaaagcctcctcatctgttccacaaaggcattcagcctgtcaatctgctgcattcccgaggccagcatttcctccatgtcctgctggcttaactgccccgcaggcagaaactccataagcgtttcctggtatccccgcagcactgcaaggggggaacggatatcatgggcaatgaccgccttcagcgttctctcctgttccaccatgctccagagctgtcggttgttttcttgaagctgggagcgcatgcggtcaaattcccggcacagacttcccatttcatcctttttcctgtaatctacaggaaaatccagatggttttcctgtatttttctggaaccttctgtcagtatctgaagcggctccctgatcttatcacggtaaaagcaaaaaaccgcgatcacactgccgatcataggcagtataagcatagaccatgtttccaccgcgtcgcagatctgggtcatgacataatctctgtgaagcatatccttctgtgcgggccttgtgatctccgtgatatttcctgtctcctcctcaaagtccagatgtttatcccagtctgtatattccgcccagatttgtctctgagtcccctccgccattttgacaaccacggctgagaggaaaaaggtgataatgatcgccgcagtcatgtaaagtacaattgttttcctaagtgaaagattccttattttttccatcggtacccacttccccatacagtctcaatatactccgttccggtatattcccctatttttctgcgtattcttcttatgagttccgtgatcaccctgctgtcgccctccgcatcatagccgcagaccctttcatagatccgctccttgtcaaacacctgacccggattttttgagaggaattccacaatatcgtactccagttttgtaagctccagctcacggtcatcatacagggctttcctggcactatagtccagcagcagcccctccctgtatctgagatttggctttttcctgcctcgctcctctctttttatatgtgccgtgatcctcgcctccagttccttcaggctgaacggcttgacaatatagtcatctcccccggaaagcaggccgtttatcctgtcctgctcctcaactctggctgtcaggaacaatatgggacatgagacgaattccctgatcttcatacacagttctattccgtccatacgcggcatattaatatccagcaagatcaaatccgggttatcctctattttctccagggccgttaagccgtcatctgcaagcaaaatgctgtatccccttaaacggaaataattttccagcattttgagcagggctttatcatcatcaacaaacaacaatttatacatatatcttcccttccatgccctatagacgaattattttcaaaacaaaagagtgcggcagattttctgacaaatgaaaaaagccgggatttaccgctgcagctccctgtcacaagatcctataactggaattatactataaaaacttgtatcctacaaataaatcacctcggaaatactcttgcatttctcaaacaaagtgctataatattttatatggaagcatagctcagccgggatgagcgttcgcctcacacgcgaaaggtcaggagttcgagcctccttgcttccattatttttttggggatatagctcagctgggagagcgatacgttcgcaacgtataggtcacgggttcgaatcccgctatctccatgaattttctttctcacatcccataaaaggcagtattatgctgcttttcataaaaactttagtatattcatacaaatatcaccaacccttcacattttttccaagaaatggtcataattaccatgtatactcttattataaaaagagtaaaggaggcttaacacatgataggaactttaatgaataatggccgcacctgtgttctcaaggagaacggcggcagcaaaaagatacccgttcatccggaacaatatgtatatgtgcaggtctccaatgcgtggatacctgccatactgaaatattccggtgaacggcagaactggtattttgaatacctgcccaagctgcctgtaaatggctgcagggttatgacaaagtaaaaacagaatacggcaagataaaccggggagactgccagatataggcagtctcttttttattggtaacgtgtttctttaccaatgttgtattctcctcctcttttgatataatggttaacaaatgttaacgaaaggagtccactcatggcaaaacatgcagtaaaaattcatacctcattatgcatcggctgtggtttatgcgcaaagacatgtgctgcgcacaatatcgtactgaaaaataaaaaggcagaaaccatattagatgactgtatcctgtgtggtcagtgctctgcagtctgtccaaaggaggcagtcaccatcagcggctatgatacaaaaccgatcacccaaaatggcactgtacacctgaatccccatgaagtcctggatgtcatccgcttcagacgcaccatacggcagtttcaaaagaaagagattcctcatgctgtgctggaacagatcctggaagcaggcagtctcacacatacagccaaaaatatgcaggatgtctcctttgtggtccttgagaaagaaaaagacgctgtggaacagatggctgtccgcctctttaaaaaactaaagccctttgcggatttgttcagtcctattgccagacttaataaaatacacccacattttttcttcttccaggcacctactgtcattgttatcctggcaaaagacaaaaccaacggcatactcgcagcacaaaatatggagtttgtggcagaggccaacgggctgggtgtgctgttcagcggatttttcacatcttccgccaacatatcaccgaagatcaaaaaggcgctgaacgttcccaaagggaaaaaaatggctgccaccctggtattaggttatcccggtgtaaaatttctccgctccgccccgagagaaaaaccggatgtcagatatatgtagtgaactaaaaatatacagaggaataaaaaatggaaaaggaatgtgaagagcgtttacaaaaaatcgtccgtggttttctggactgccaaaatgcgtttactgcaatcggcgatgagacaagacagttgatcctgctggtgcttttagaaaatgatctgtcaggcataagggtcggtgagatcgcagagaaaacccatctgacaagaccttctgtgtcccaccatctgcgtatcctaaaagacgcgggtattgtcaatatgagaaaagaaggaactaaaaattattattatgtgagtttggatgaatcccaatggaagaatatgaccgatctaatcaatctcatctatgaaagcattcggcaaactcatgaaatacatgataaggagtaaaagactatgatattatatttttccggaacaggcaacagcgcctacaccgcacaaaaaatcgcagaaaacattcaagatgacacacttgatctgtttcaaaaaatccgtgacagcgatcacacccagatttgttcagataaaccatgggtcatcgtatcaccaacttacgcatggcggattccacgtattcttcaggattggcttaccaaaacaaagctgacaggaaataaagacatttattttattctgacatgcggagggaatatcggaaatgcaggtgcctatataaaaaaattgtgcacctccaaaaacctgaattttaaagggtgtgctcctgtcctcatgccagagaattacattgcactgttccgcgctccccaggaggaagaatcactggagatcatacgcagggctgaggataccatggaccaaatatcacatttcatcacaaataatgaaatgctcccgcagccttccctcacttcaaaagacaggtaaaacagcggtattgtaaacaatatattttatcccgcatttgtacatgccagaaaattttataccaccaatgcctgcatatcctgcggcaaatgtgaaaaggtctgtcccctgaaaaatgtccatctggagaaaggaaagccggtgtggggcagccgctgcacacactgtatggcctgtatctgccgctgtcccgttgaggccattgaatacggccagcataccaagggcctgtcccggtacgttttcccgaaaagcattaaaaataagtaacgattcaaaatcctcacattttccaacaaaaataaaacctttttcttcctcctccggttatatataatggaagacaggaaagggggcacctatggatgacagaaaagccataagggaaatacaaaacggcaataaagaatacttgaatttgctggcggaaaaatattacaatgacatctaccgtttctgttgttaccagatcggagatcccgataccgcatatgatctggcccaggaaacctttcttcgttttatccgctatgtggaccactaccggtataaaaacctgaaaggctacctgctgaccatagccagaaatgtctgcttcgattttttcagcaaagagactgcggttcaccggcacctctcctattcccccctggacgaagcccgcgaagaggagcctaccgctgaatccctgggacatttgcccatgcagagcgatctgctggtgaatgttatccgggaggagaattccaggctgcttgtccaggctcttatgaagctgcccaagatccagagagaggtcattgtgcttcacagcctctacggtctgaagcacagagagattgccaggatcacaggcaccaatccatccacagtgaaatcccggatgaaacagggcatggacaagctgaagcatacattgagaaaggaggatttttatggatgacaacaagatacggataccctctccgcctatagatgagggtaaaaaaagagattccctggaagcagtccgcagggaagtatcaaaaaaagacctgtcggcacatatctctgtcccggcgctgatgctggaccagatccattatatttccatggaatattggatcatacaggcactctttctggcagcggctgtacttttcctgacctgtttccaatcgctgatgcagggcagtgagagtatactcccctctgcctgcgctgtctcctccggtctgggactggctgccgttctggaattttcaaaaagccgctcctggcatatggcagaattggaacagagctgctgctttaacctgggacagatatgggccgtgaaactacttttttcagcaggactgaacctgtgcgtcctgacactgctgcttcttggtgtaaaacagcatacaggatatgggatctttgcactctgcatgtacctgtttgtaccttttatcttatccaatgtctgctattttttcctgctgtctacaagaagattctcctctcagaaagctatattgtcgggaacccttcttctgctctgcctgtttttcctgttcccatcagcctttcccaaggcttatctgggtatctatctgccggtatgggcaatggtactggcagccggaatcctgattctggtcatagagcttcacagactgttccacagtttaaccacaggaggtaaagaattttgctggaattaaaaacgcagaacataacaaaacgttacaaagaaaaaacagccgccgacgatatcacctttacactgaaaaacggtgtgtacggacttctaggggaaaatggcgcgggcaaaaccacactgctgcgcatactctgcggcatccttgcgcctgaccggggagaagtgacactggacggcatacctattcagaacatgggcgccggctaccgggctttgcttggctatctgccccaggatttcggctattatcccgactttaccgtaaagcggtacctcctttatctcgcctccttaaaggcagttcccagggatgaagcgcttagaaaatacagggaaatgctggaactgaccggacttgccggggaagaaaagcaaaagatcaaacatctctccggcggtatgatacggagactgggcattgcccaggccctgctcaatgatccgaaaatccttctgttggatgagcctaccgcaggccttgatcccaaggagcgcatccgtttccgcaatatcatcagcactctgggacacgacaggatcgtgctcctttccactcatatagtctccgacgtggcaaatgccgctgagaagatactgatcatgcgccgtggaaagatcattgaaaataaggaaccggatgccctgatccgggcggcagacggccacgtatgggaatttgtcatatctcccccggaagcggatatctgccggaaacaatttactgtctgcaatgtaagaacagaaggaaccggcctgcggatgcgtgtcctctctgaaaaatgccccttccctgacgcctcccaggccgttcctgacctggaggatgcttatctctacgccacagaaaacagggaggtgctctgatatgcttttcagaaatgagttatataaaatttgttcaagaaaaattcttttcatgggcgcactgcttggcttgctctttttggccgcctactttcagatgtccgcgcttggttcagaatatgcctatgacaatggcacctgtttaaggagaaccgatgccatacaatacaacagggaaattgcccgccgatacgctgggcctatgacccaggaaaaagcagaggccatagtaaaggaattcggatggcatatcaatgaaaatgacctggaaacctctgatacaggcgacactttaccgggttattatgacaattccaccagccgttttgtgactgtcaatctttccgattccagaatccggggcggcgaaccgcccacagctctcgccggttccgatgacaagtacgctgcggagataatgagcggcaaatatgaatatggttacatcggcggatgggacaacacctttagcgaaatgcatatgatgctcctctggatcgtctctgctctggtgatcatagcctgtgcccctgttttctctgaggaatatgcccaacaaactgcccccatcctgctgaccacgcagaacggaaaagggaagacagccgccgccaaaatactggcagcgtttacatgggcgggcggagtgtatcttctgtttacactcctccttgtgggagcctttctgcttgtatacggcagtgacggactctctgtcagcgcaggcctttcttttcccgacttaatgaccggaaacattttctggaatggggatacccggaagaccaccggcgccgtactgcttgcttatctgcttacaggacttttatccatacttgtaactgccgctgtcacactgttgatatcctcaataaagaaaagttctttctctgccctgctttggtccgctgccgcttatctgcttcctgctgtcatttacactgtttttcttgtatccatgaaagtcacaagagctttgatgatactcaaaagtgttataaattgtctgccgtttttcctgcccatgcgtgaactcacatccattccctttgcctgccgcctgtttggatatatattctccgcatgccttctggccttttgctgtctgctgggatggaaaaaatactgccgctgccaagtgggaaaataaacagacctacctgcataaaaaaatctgcccggctgcaaaaagaattgcagtcaggcagattttttactgttcttccagaatcagaagattccatttctgtaatgtcaaggcatcgccggccttctttgtctcccctgaaaacagttcagtccatgtcccttccggacacacagcctcctgttctttaccggaataattcaggaaataatagatttgttttcccatctggtttctgcccccgcggacgatcacagggaatccgcaggaaccggggttcggcctgatctcacattcctccagcagctcacccaaaagttttttcagcagttctgcgctgaacatacatcctaaatacacggcttttcctctgtcgaatgtattctctgtcactgccgcatactgcccccagttatcatgcacgtacctaagaagcgtctctgctccccttgtctggatgcattccaggaataccttggctttctctttatcttctctgccgcagagccttccttccagaaatgtctcctctgtctcctccgggtatgtgaactggttatacataatgccaaaacactctgacagaatgtgaggctgtgaatcatggtatacctttacattttcgttggtatatcccgtcttaaaggttcccaaaagacagccgcccttttccgtaaaggaccggatcctgagcagtgtctcttccggcacacagtagagcgccggaaggatcagcatcttataatcctccagattttccgcatccggtgacacgaaatcacactccacattcatctcatacagcgcgtcatagatccagcgtaccacatcgttgtaggacatctctgtacctcctccgatagggaaccatttcagccctgtcagtgcctcattactcaccataatggcagccttgttctgctttttcagatggatgagatgacttcccagacgcttcatctcactgccgatgacaacagcttctttatatgtcttattctccgcaaaatcatggcttaacagcccgcgccaatatgtctcaaaggaattatggatggagtgccagtgccagtattccacacaatccgccccgcctgccaaatgggaaaatgcctgcagcctgagctgtccgtcatagggcacccactgggcaaatccctgggcttcagtctccagcacataataattgtcctgtttcagggaacgggtcatatccccgccaaaggcaatctcctttcccgtcagctttgactgggtggggtggtaaatgtcacagcccgcaatatccagacattttgaagccctaaaatggtccacatccggctgtacgccaaaagaataatttctccactcaaagtcaaaattctgggtgataaactggtcttcccttttatattcccgcacaatatctgcctgccaggacaaaaattccgtcacaaggccgcgctggaatttctcaaactcacagcccagactgccattgatggtccctctcacatccggaaaatcctcccaggaatgaagggcattgctccagtaattcatgccgaactcccggttcatggcctccacatcacccccgaatttttcctttaagtatgcaataaacccttcctgtacccgctctccggaggtaccgtagtgttttgtctcattgtcgatctgatagcctatgatacattttctgtccttcacatgctccatcagctttcttatgacacgttcactgtaaaaccgataatggcggttcgtaatgtccatgatctgtctggctccgtagatgcccctgccctgtttggtcactgccattacatccggatgttttttctccatccatgccggaatggcataggtcggcgttcccacgatcacatgaatgccggcctcctccatggcatccagcaccctgtcaatgtgataaaagtcaaacacaccgtcctggggttccagggtgctccaggtggattctgcaatccttaccaggttgatccctgcctttttcatcatcttcacgtctttttccagtctgtcagaaggcatatattcatcgtaatatgccaccccatagagtaattcttccatatattcttctgctgtcctttctggttgataatccctgtaccttttccccggctttttaatccccttatgaagctttttcgcaagccgcgttctgatatcttatacttatcatctttttccggattcgtcaacttaaatggggcatttttctgttcatagtggagatcttccccataataaccgcagaaagggtacaagctgctgacaatttacaaaacatgtatgctgtcaatacgggacgtatattgccatcaatacggcggatttttcccctctaccaggcagcgaaaaaagcgctcccagcctgattcctattcgggccggagcgctgttcacatttctttatactatttcatctgaatcaatggattatcttatcataaatatcaaagcagtccagtgtagcaaaatagtcctttggtgtctccgcccggcggatcagctctgtactgccgtcctctttcagaaggatctctgctgattttaattttccattgtagttatatcccatggcaaacccatgagcaccggtatcatggatcaccagcaagtctcccttttcaatttctgggagcatacggtcaacggcgaatttatcattgttctcacaaagagagcctgcgatatcatatttgtgatcactgggcctgtcctcttttcccatgacggttatgtggtggtatgcgccgtacatggcagggcgcatcaaatctactgcgcaggcatctacgccgatatactctttgtgggtgtgtttctcatgaatggcttttgtcaccaggcagccgtatggtcccatcataaaacgccccatttcggaatagatcgccacatctcccatgcctgcgggaaccagcacttcctcatagaccttctttaccccggccccgatcgcccgaatatcatttggctccatatccggagtatagggaatacccacaccgcctgacaggttgatgaattcaatatcagcccctgtctctttttccagctttactgccagctcaaagagttcttttgccaaaacgggataatagtcatttgtcacggtattacttgcaagaaatgcatggatgccgaacttctgcgcccctttttccttcaggatacggaaagcctcaaacatctgctctgtggtcattccgtattttgcatcccccggattgtccataatgccgttgcccatctcaaacacaccgccgggattataacggcaactgatgcgtttcgggatatagcctatggtcttttcaaggaaatcaatatgtgtgaaatcatccaggttgatcacagcccccaatttttcagcgtacacatagtcttcggccggcgtatcgttggaggagaacataatctcattacccctgcatcccatagcctcggagagcatcagctctgtgtaggaggaacagtcacaaccgcagccatattcccttaaaatgttgatcagaaacggattaggattggctttcacggcaaaatattctttaaatcctttgttccaggaaaatgcttcgttcactgcctttacagtttcccggattcctttttcatcatataaatgaaacggagtcggatacttttttataatttcatccagttgttctttggtgacaaatgtctttttctccattaaagttttctccttttgtaaattggtatattgtttcaatccacctggcaacagcaagcagggaatccattttgccgtccagcagttcgtccaccggtgaggaatctgtgagcaggtccggtatcataactgtgatcattcccgctccatgggcagagcgtatcccgttgtaggagtcctccagcgctagggcacaggccggactgaccttcagagcttcacaggctttcctgtagatctcaggggacggctttgcctctgtgaccatactccctgttatcacagcagaaaaatacgcctggataccttcccgcttaagattattctccgcataggcatgactggaagaggttgccactgccatagggatatgtctctgggccagtacatccagcagttcatgcagacctttctttgcaggcaggccgttcttctcctcgtattcccaaaacgccttcctgtattcgtcccggaacagctcaaatgggaaatcctccccgtacgtatccttaaaatggcgttttctcttatctacattaaagccaagggtatgaaaaatattatcccccagcttcccgtatcccatccgttctcccgccacgtcccaggaatactttacgatcctctcactgtcaaacataaggccgtccatatcgaagactactccgtggatttctcttttctccatatttctgctcctttttttatacggatactatcataactgtttttcgcctattttgcaacaaaaaagctcacagaaaagccgcagaccttataattctgcggcttttccaaatcctattctattatttattggcagccgttaggcagcctcacagtcaaaagtaaaaccatacctttattttacttcgatcacatgcagcatattggtaacattctgctcatctttgcggctgttggtagccgggtcacctgcggtgaacactgcaagctggccttttttcacaaggcgtttgcgttttacggtttccatagcacttgtcagaatgttttctgtggtgtcttttgtatttcctttcagaggctttacaccccaatagagctgcatcttatgctgtacaaattcgttgggtgtgatggcgtaaatcggcatggtggggcggaaactggataccagtcttgccgtcttgccggacatggttggagtgataatgcagtccgcgtcaatatttctggctgtgcggacagaggaaataccaatggcactggaaaccaatgtctgtttgtacatggtcctgtgctgaatgtatttgtcataatccacatgcttttctgtatcctcagcgatctcacccatcattgtcagagcttccaccggatattttcctgctgcggtctctccggagagcataactgcatcggttccgtcatagatggcatttgccacgtccgcaacctctgctcgggtgggacggggattgcggatcatagagtccagcatctgtgtggcagtgatgaccggaatgtaattttcattgcatttcttgatgatcagcttctggatatatggcacttcctgggcaggtatctccacacccagatcacccctggctaccatgatgccgtctgctgctgcaatgatctcatcaatattctcaacgccctctgcgttctcgatcttggcgataatgctgatctgctctgcgtgatgctccttcaggatcttgcggatctctttgatccctgctgcattcctgataaaagaagcggcgatgaaatcaatatcctgctgaatgccaaagataatgtccgctttatctttttctgtgatagccggaagcttcactcttacattcggcacattgacgccttttttctcacccagctcgccgccgttggcaactgtacagacaatatggtcttttttcaccactttgacgtccagttcaataaggccgtcatcgatcaaaatcttgttgcccggtttaacttctcttgccagtccgggataggtgatggaacatcccttttcgttacccaccatttcttccatatagagagtaaaatctgcgccctctgtcaaaattactttctttccatcctccagaactccggtgcggatctccggtcctttggtgtcaagcagtatagctaccggcttatccagctcttctctgacatttttcagcaggttcatacggtttctctgctcctcgtaatccccgtgtgaaaagttgaagcgggccacatccatgccgtgtctcaccagagctttcatagtagctttttttgtccgtattcggacccatggtacatacaattttcgtcttgcgcataatttcctcctaatgatatcgtcactttatatgttcatgagtaaaaagatgatcctggcagtattcataattgccgttgcatttggagcagaaacggaactccagattgtctccgtccttttctgttctgccgcacacggcacatttatgcttcgttacaccaggtgccatcttcggatgaactgctttttgaaactgctgccgcctgtgcacttcttttggattgatatggctgtaattcctggtggcaaaaaagaacacgatgaagttcagcagagatgcgatgatcatcattctgatggaccatataggtgtttttataaagttataggccaggtatgccacatccagataagccagccacttgatcttcaccggaatcacaaaatacagcataagctgcatatccggataactggccgcaaaagccaggaagatggacaggttgatataatatgtggagatggcagccattccgtacagggagttcattggtccctgaataaaataaagcagaaaagcaccgatgatcgtacttaaaataccgcctaagatatagacattatatctgaaatctccccatgtcttctcaagagaagttcccagggaataatacaatgcaagcataatgatcgtaaaaatattaagactggaaggcgggatcaaaagccagctcacaagtctccatatctgtccgtgcagaatgtgggcaggactcagcatcaggtaagcgctgaaaggaattcctgtaacgttgcccagaaaataaagcacatatccgatcacataaagcaggatgatgtactttgtcagattcctgatagcgaaacgcccgcatttcctttccattttgttcaaaaaattcatatattctcctcgtttctaatcttatctttcccccctcagggaaatcggtactgcactgccgcaataccgaagatataccgttttattaacttaaaacaggttcttcttggagaagatcaatgcaaccagtaagctcagtaccagagacagtacgatcacaatgacaaacccgtagggactccccgcaaagggcatcccggatgtgtttacattcatgccgtacgcactgaagatcattgtcggaatggacatgacgatggttacggttgccagaaacttcatgacaatattcagattgtttgaaataaccgatgcaaaggcatccatcattccactcagaataccactgtaaatattggccatctctatggcctgcttgttctccacaatgacatcctccagaaggtctgtgtcatcgggatactgtttgatccgttccactttcaaaagcttctccagcaccacctcattggaacgcagggatgtggtaaagtacaccagggacttttccagttccagaagctcgatcagttcctgattcctggtggatgcgtgaagcttctcctccacttcctcactctttttatctatgatgcgcagataatgcaggaacatactggcattgttataaaggatctgcaggataaatctggtcttcatataggtatagaagttccgcacacggccgtccatgaatttgccaagtacagaggtatcctccagacacaccgtgatgatcatctcatttgtcacgatgatcgacagagggatagttccgtaccagtccttgtcacccctctcctcaatgatgggggtgtctaccaggatgagcgtgtaattgtcctccacttctatacgggagcgctcttcctcatccagaggtgctcgcagatcgtcaacctctatctggtacttgttggaaacttcaaaaatttctgtggctgtgggatctgtgagagcgatccagcatccctctgtggcttcttccacctgatgtatttttccatctattgttttaaaaattctgatcatgttatctcccttcatgccccataaacgggcacaaagattcagatgcgcctgcctatggggtttctactctttattttattgtcttgattcgatttcccgggacaaggcccaccttccatgataacacttcctttctcttattcttcctcacatttatggaagattatactatttggtgtctctaccttcaaaggtttccctttcataaccagcagtttattctcataatcaatggtaaacgtggtgatagagttggattcatggttcacaactgccagatgttttccgtcggggaatacctccaggtctttgggatactcaccgctgatgggcagtataaactgtttttccagactgccggtctcctcatccactttatacatggatgccgtatcttcccctgctgtggagcagaacagatactcaccgtccggtgacaggcacatgccggatgtggcatcatgggtctcatcatcatgggacgccagcgtgctctctgtctggatcagctcgaaaacggggttcttgccgcttccgtcataacgatacacctgtacttcattgctcagctcaaaattcaggaatgcaaacttgccgttgggactgaatttgatcagtctcggcccggattctcttacacagcgcagcacatccacaagctctaacttgctggtcctggcattgacacggtaaattttcatctggtcaatcccgttgtccacagcacagagatactttccatccggtgtaggacgcacacagcttacatggggacggaaatttctctccgcaacacttcccaatcctctgtggaataccccgtccatgacacttcccagacgtccgtccctgtgggtatgtaccacggtaactttaccgtcgtgataacctgccacatagagatatttcccttccttgtccgtggacaggtggcagcctctcattccgtcaatgtctactttattaataaaggtaagatctccgtccgaatcaatcgaaaatacggcaactccttcgtcggcaatggaatagagatatttcccatttaatgatatggccaggtgggaggaattatttacaggaatgacttttctctctgtaagtgtcccctcttctacatttacatcatataaatggattccgatactgcttccatgggtatacgttccaacatatgcaacatacttctctttcatttatgcaataccctcctgttttattctgattttccccgtttggcaatgatttcctgccgctatccgtggtctaccgacattctaccacaaactttttctttatacaatgcaattcccgccaaattcgcaacatttatgttgacaaggtttgtgggtttagtataatgaaattcagagtctttccacggaagagccggtttggaaggacaaatttagcattatttcatatcacgtaaaggagaacgcgaatgaatcatacactggtggatttaattgacatttccaaaggatttggcgatcagattgttctggacaagctgaatctgtccatccgggaaaatgaatttcttacccttttaggccccagcggctgtggtaagacaactactctccgtatcctgggcggtttcgagacgccggatttcggacaggttatttttgacggagaggatattaccaatcttccgcccaacaagcgaaatctgaacaccgtattccagaaatacgccctgttctcccatatgaatatagaagaaaacattgcttttggtttaaaaattgccggaaagagcaacgcttatatcaaagacaagatcaaatacgcactgaaactggtaaatcttgaaggctttgaaaaccgcttgcccgattccctgagcggcggacaacagcagcgtgtggccattgcccgtgcgatcgtaaatgagccgcgtcttctgcttctggacgaacctttgggcgccctggatctgaagctgcgccaggacatgcagtatgagctgatccgcctgaaaaacgagctgggcatcacctttatctacgtgacccatgaccaggaagaagcccttaccatgtcagataccattgtggtcatgaaccaagggtatatccagcagatgggttcccctgaggatatctacaatgagccgcagaacgcatttgtagccgactttatcggtgagagtaatattatagaaggtactatgcttgaggacaggctggtgaagatcctgggtgccaagttcccctgtgtggacgaaggcttcggccgtaacaggcccgtggatgttgtcatccggcctgaggatgtggacctggtaaagcccgaggagggcacgatccagggcgtagtctcccacctgatcttcaaaggtgtccactatgagatggaggtccaggcaaacggatttgaatggctggtacacagcactgacatgttccctgtgagccagaaagtcggcatccatgttgacccctttgacatccagatcatgcacaagccggtatcggaagacgaggaggccataggagtgaatgaatagaaaaaaattactgaccggaccttattttttctgggccgtggcatttattctgattccccttgccatggtcttatattatggtctgacagatgtggacgggcatctgacttatgaaaatcttctggcgatcggaactgtggagaatttcaaggccctgtgcctctctttgctgctttctattgtcagtacagtcatctgtctgttgttagcctacccccttgccatgattttatccggcatgaaggtgaatcagaccagttttatcgtgttgatcttcatccttcccatgtggatgaactttctgctgcgcactatggcgtggcagactttgctggagaaaaacggcgtgatcaatcagtttttaaattttcttcacctgccctccatccagctcatcaatacgccttacgccatcatactgggcatggtgtacaacttcctgccctttatggtgctgccgctgtacaatgttctgtccaagattgacaaagacgttatctctgcagccagagatttgggtgccacggagctgtacaccttcaggaagatcatctttcctctcagtctgcccggtgttgtaagcggcgtcatcatggtatttgtacctgctctcacaacctttgtcatctccgatctgttgggcggcagcaagatcctgctcatcggaaatgtcatcgaacagaaattcaagcagggcagcaactggcatgtgggaagcggactctccctggtattgatggtctttatcctgatcagcatggtggttaccacaaagtatgacaaagacgggcaaggaggtatgttctgatgaagaagacagccagaaatatctatttggcgcttattctgatcctcatgtacgcgcctattgtgacactcatgatcctctccttcaacgcctccaaatcccgctccaaatggggcggattcaccttgaaatggtatggctccctgttccgggatgacgccatcatgagtgccctctacaatacgctggtcattgcgtttttatctgcaatactggcaactttgatcggaacctgcgcctctatcggcatcaattccatgaagagcaggtggcgcacagttttcatgggtgtgactaatatccctatactgaattccgatattgtgacaggtatttccctcatgcttttgttcattgcatgccggtttacccttggtttttctacgatcttaatggcgcatataacgttcaacattccctatgtgatcctgagcgttatgcctaagctgaagcagaccaacaagagtacctatgaggctgccagggacttgggcgcaggccctttccaggcgtttatgaaagtggtattcccggatatactgcccggtgtgctgtcaggatttctcatggcatttaccatgtccctggatgattttatcatcacccatttcaccaagggaccgggggtggataccctgtcaaccaaaatatattccgaggtgcgaaagggtataaggcctgagatgtatgcgctctccaccctgctctttttatctgtcatggtcatcatgatactggtaaattcagcgcctaaagaaccggataaaaagcgctcctcagaccttgataaaaagaagcttcctctccgtcaggtaatcccggcagcccttgttatccttgtggcaggggccggattcttcttccatctgggaaacaagggaagtgtgtcggatgaaaagctcattgtctacaactggggggaatatctggaccctgaagtcatagatatcttccaggcggagaccggtataacggttacctatgaggagtatgaaaccaacgaaatcatgtatcccaagatcatgtcaaaggccattgcctacgatgtggtctgcccctctgattatatgatccagcgtatgcgtgaaaacgatctgctggctgagatcaactgggacaatgtgcccaatatcaaaaatattgatccgacttatatggaacagtctcaaagctttgacccggaaaacaaatactcggtgccttactgtgtgggcactgtaggtatcctctataacaaaaccatggtcaaagaacaggtggacagttggaatatactgtgggatgagaaatataaagacagcattctcatgcaggattctgtacgggatgccttcgcggtggctttaaagcgcagaggttattctctgaactccctggtcgtggatgaactgattcaggctactgatgatctgatcgctcaaaaaccgctggtccaggcctatgtagtagaccaggtaagagacaaaatgattggaaatgaggctgcattgggtgtgatctattccggtgaagccctctatacccagagggaaaatcccgacttggaatatgtcattcccaaggaggggaccaatgtatggatcgattcctgggtaattccctccaatgcgcagaacaaggaaaacgcggagaaattcatcaatttcctctgccgtcccgatattgctctgatgaactttgaatacatcacctacgcgacacctaacaaggcagccagagaactgatcgaagatgagagcatccgaaacagcagggtactcttcccggaggcagaggatctgcagggaagtgaaaccttccagttccttggcgatgaggcagattcctattataatgaactttggaacaaagttaaatccaaataagaagctgctgcctgcaatagatataggagtttttatgaatcggatactgatttacagaataagcgaaaaggattccccctgcacggtggaatcctttttaaaagccaggggatactcccggcagatcatcatacaattaaagaaaaacagcgacagcataaaagcaaacggcaggtgggcctatataaagaccatgctccacaccggagatgagctgatgatattcttggaagaaccccagtcatcagaacgcattcttccggtacctctcccgctctctgtcgtgtacgaagatgaggatattctggtggttgacaagcccgctgatatgcccgtgcatccctccatcaacaattatgacaacactctggcaaatgccgttgcatactattaccaatctgacaaagagccatttgtctttcgctgcatcaatcgtctggaccgggataccaccggcctgctgatcgtggctaaaaacgccctgagtgcctccatattgtctgcacagatgaaggaacggcagatccacaggacctatctggctctctgtgacggaaccctcccctcctcccagggaaccatagacgcccccattgccagaagagaaggttctgccattgagcggtgcgtagactttgaaaatggagaacgagcggtcacccactaccgagtattggagacatgcagtcaagtcacactggctgaactgcgtctggagacagggcgcacccatcagatccgggtgcatatgcagtacctgggcgccccccttatgggggattatctctatcacccggatttcaccaggatctccagagttgccctgcactcctccgccctggaattcatgcatcccataaccggaaaacccatgcggttccatgtaccgctgcctgaggatatggaaaaggccaggcagcccgcgtgatgtaacgaaaactcatcgcatacaatccccctttttacatgatcctgctgcttttgtatgcaggaaattgggaataaattaacataccatttttctatttcattcttttacagaagtgctataatgaaaattatagttacgatgcatagctctgcaaaaagcgcagttctgtgaatcgcaacaaattataaactatatatgtatttatacattatattggaaggctgtcctactgtaaaaccccggacagtcctgccaatattgatcaagggaggaattcaaatgactaaagttaagattgaaccgggtatctgtaaattttccactctcgtcactgccaccgcatcagaagatgaagagaccgaagtcaccataaaagttgccagcggctgtcccagcgtcaaaaaaatgatggaagaacttggaaacacctttgatgcctacgaggtctgtctcgtcaagccgggtgcaggacccttcttcgagtatgccggcaaaagcttccccgtacatgcaggatgtcctgtcatcgcagggatcactaaatgcattgaggccgaggccaatctggcgctgaaggcagatgcatctatcacattcctggacgcagaataaatttccggcttcagaatcaggaaagggggtttcctctctctgtgccaagcatgcaaaagccgggcggaacataaacctccgcccggctttcacatgctaaaaatatgaaaccctgcctcttacagcattctgatcctgggcacctcatcaatatgaaggtatcttcccagtgtctttacaataatatcatggttgatatagtgattctgattagtcaccataatggcgcctaccacgcctacttcctccacacgcacagggaaaccgcctcccatgcaggaaaactctttcggatccagggcgatatccaccatggtctcctcattcttctgcagctcactgtataccaaaaggctgctcttttccagcgtacggactgtattgaatgtcctgtccatccagcggtcattgttcagattggttgtattccccgcgtatttaaatactgtgtagccattattcctgcggatggatacagcacagtccagacctcttcgtctgctctccgccacaagcatcattcccaattcccatgcatcctcgtttgtaaaatgcgaaaactggagtatctcctcctgcatactgagtacggtgatcacttcatccattgtcatatacattccctcctgtacaagatttgtaacagttccgtatcttccctgttacggtaattcaaatatatgccgcggctggcccgcggcgcagcttaacggatcctatccggaaatcccactttccgctgtaccttacgcagcgttttgttggcaaaatagctggctttttcggcattctccttgatgatggaatcaatgtatgccttatccttttccagtctcgcaacctcatcctgtaaaggtttcagaacacttacgacagcctcacccacagccatcttcaaatccccatatcctctgccctcaaaatcgcgcagcgcttcatcagttgtcttaccggtacatgcacagtaaatatccagcaggtttttaagtcccggctgttcctctctgtatgcgatacaagcctcggagtctgtcacggcacgtttgcatttacgcatgatcgtatccgggtcatccatgagatagatactgccattgggattttcatctgacttggacatctttttggaaggctcctgcagactcatgatctttgcgcccactttgccgatataagcttcgggaatcgtgaacacatctccgtaaatattgttaaaacgggtggcaatatcacgtgtcagctctagatgctgcatctggtcaatacccaccggaaccacatctgcctgatagagcagaatgtcagcagccatcaataccgggtaagtgaaaagccctgcattgatattgtccgcatgttttgcagatttgtctttaaactgtgtcatacggctcagctcacccatataagtaaaacagtttaagatccaagccagctccgcatgtcctgatacatgggactggtagtaaatgcagtttttctttggatccagtcctgccgcaatatataatgtcagaagtgcacgggctcttttgcgaagagtagccgggtcctgacgcacagttatggagtgcatgtccacaacgctgtaaaagcactcatattcatcactcaatgtcacccagtttttcagcgctcccaggtagtttccaagtgtcaggtttccggttgcctgcattccgctgaataatacttttttatcgttgatcatcttaatgtcctccagaaatttactacgttaaattgtatcattccgcccgtacaaagtcaaatctttataaccaaatccctgtaaaatggtccgccggcagccggatttctaaaaaagaaggatgcagcctggcggtaatgcagcgctgcaccaggttttcctggcgttaaccgcgcctgccggcatacatccttatatcaaatatgttagtatgaatttatcttatttttataggacacctgcattctttccatcgcatattctccgatcagccaaaaacaaggtccaaaccagacacttttctgtcccgcaagcaaaagggcgttttctcctgcaaaacagatggtgaccagcagcaagatccaggaaaatagtatccctgccgccgtctcccctgcccctgcctttttctgtgtcctgcacctgacagcgtataacccccatgtcaaaacacagtatattaaacaggaaaagaaggggcggagcacaagaagctccaggctcgtctttttcgtttgaagaagcagtttgaaattatcctgtatctgctgcgtcatgtgtttccagaatgtaaagtctgaccattttgttggcaccacatccctggtcaggccgggagatttccaaaaaagcatgaaaaataggactgtcatcagtatcatcactgcccacaaggctgctgtctgtatccgtctgcccctctgcgccctcataattcctgtgatctgccctgccattctgagaaagatcaccattggaagacagaatatcagcagctttgcgcaggctgaaaaatactttcgctccagtacctttccctgtattgcgtggcgcagaagaaatgcctgaaccggattttccgaagattgaacttccgtattcgcctcatatgctatggtgtcaaggacactgtctccctccctgactgcctgtacggctgcggttccctccatcccccttaaaatcccccggacagtcagaattcttcccctgtaaagaatcccctcccccatcacatctttgcttccgaacaatttgtaagccatatcctcagacagaagacaactctcctcgtcctccccgtacagaggcgccgatgccggcagtaatccccgggtctcccccagcacttcaaggacaaaggcagtctccactctttccagtttcctgctttccagatactcttcctccctctccccccaaaaggtgcaggatgcaggaaattcctgtttttgctcctcctgccggataaactctgcctcctcataggtccaggtacccttcgtcttttttacggaaaccccttcactgtatttctctgtacccatggcagcagcctctgccaaaaaccagcagagaaacagcaaacctaaaactacaaaccgaaagacagcacctttcccgccgctcatgtttcccgcaggcgtattctgctgcccgcaccaatgttcctgtcagatcctgtgattatccggtcatccggcagaaggctgctgccctccagcgctgcataggtactgtttttatccttcacgaccacgtcttttctggcggctgtcagttctgtgcccagaaccgtctccttttcctccgcgaccagtacataatatttagagttttccatatgcagggcttccacaggaatacaggtgtcctgtaccttttccttacgcatactggtcatttttgccgcagccccgatctccagggtatcagcgggaagcaggaccgtcacattaagttttgtcttatcctctccatccggtgtaatgctctccacttccagattatcaatgtccttttggccgtccgcaggggacagcctgaccgggtcttttctggctatatatttttccaggctcttgtctatctgcatgacaaatctgcaccctgagcttaaatctgccagtgtcatgatcgccgtatccggtgtattatcacctgctgaaaccttcaattccgtcaccacacccttcaccggagacagaatctgcccctgatcctccttcagtttttccagcttttcaagacttttcttcttcgcatccagatcccggttatttatcttttccgtgctgtcagtgccttcagcagcccccgcatcctccagcgctctgccggcctgtatctccccgtcctctttggccttcacagcttcctctaaggcctgtctttttgcttctatatcagccagaagctgtgcttcctgctctttggcactctgttcccctgccgcctttatactgttttccgcctccgaaagagcattctgcgcctctaaaagggcctgggatgcctcctgaaacccctgttgtgcgtcagtaagctcccgggcattctcctgctccacacgtgtcctgatctcccccttctcagcctctgtcaaaggacctttttcttcctccgccagacggatttcctctgagatctcttcctccgtcttcttaagcagggcatctatccggctctgcatttcggagagttcttcctcccgctctctgcaaagctgctgcagtgttgagacatccccatcttcgccgccgctttcttcctgctgcgtctgatagaattcctccagcttttcctccgcctctgcaagtgctgcctgcgcttgcgccacccgttttcccccttcggtctctgccctttcataatcctccatggctctttgggcctgtaccgattttttctgttgctctgctttctttttactgtccagatcctgattgttaaattccagcttttttatctccgcagtcaggttttcaatctgttcctcaatgtcttccatcctgagctgcatgaggagttccccttcttccacctgcctgccctgtacggcaaacagagtctccaccataatacccggttccgtgctgatggccctctccagattctccttcaccgtcccgtctccctccacggtatgttcgatgaccttggcggagatcttttccacatccacctgcgctaccgtcacactgtcggcagctctggatatgacagtaaatgccatcatcattaccaggaatatagtcagcataaaaaatgctctctgtctcaggcttttcatcccttttgctcctatcatctctccacctctattccttcactgctgctgccacgatcccctgctccagataatcctgtccgcccaggaaaataaaaagggccggcagaagcaccaccacagaggccgcaaatgcctcgggtgcttccaaaagcccgatatccggcagatacagggaaaggggccacagctctttatttttcaaaaatgtgaggggctgttcaatgagattccagcattccagaaatcccagaaccagcgcagagcaaatacccccggaccccagaggaagccccatatacaggaatatcttcccttcgcctgccccgtctatcctggcggattccaccacagcctccggtatgccggtaaaaaaacggtacatgataaataccggaaatgtagaaaatgcccccggaagtatcaccgcccagagtgtatccataaggctcagccggtcaagcaccaggtaatttgaaagcatggtcacctgaaagggcatcatcatcagtgtgatatatactgtgaacgccggcttcttcagaggaaaatcatatctggcaaatgcccacgccgcaggcactcccaccaggagctgtcccagaaggattcccgctgtaatgcgtatggaattccaaaacattacaaaatatcccggggaatccagcagcagctcaacatacgcccgcagtgtggggtacatgggaaacagacgaaacgccgcatatccgtccccctttgccagaaccggtgacagataccccgccagttcctgttttcccatcagggaacccgccagtagaaaaagtaccggatacgctgctgccagtgcaaaaatccctaaaaccacaaaaataacctttttcattccagtcattcctctctgccccaggccctctgcagaagcaggatcagtatcataactgccagaaatgttatcactgcccctgctgccatcttgtcaagcgaaagctcccgaaaccagttattaaatacatgctgcagcagatacatactgtcatggggataatctcctgccaccaggtacgcctcacggaacactttaaaagagttcagaaaggagaggactgtgatggtataaaaaacaggcatcagattgggcagtgtgatcctgaaaaagcagtccaggctgccggcgccgtccactttggcggcttcatacagattttccggtatggcggccagacccgcgctccacaaaatgatatcataccccatatttttccacagatagctgacgaccagcacccagaacgcagcactgctgttcatccagtcctgtgtcgataagtgtaccctgcttaagaaggcactcaaaaacccctggctgtgaaataaaaacttccacaaaagcacaatggatgccaccggaatggccatggggatcagataaaaatttttcagtatcctccctttttttccaactcccgaaagcagaaccgcaactcccagtgaaagcagtaacagaaggggaatacagataaaagcaaaccgcatggtgttcttcactgccagcaaaaaggcggaattatgaaacaattccagataatttccgactcctttgaactctatccccatggcatccagaaaggaacgcctgatcacatccgcaaagggtatcaggacaaacagcgccactcctccaaggcttggcagcaaaaatgctgccgccgccctgttttgtctgtttcttcccgttttcattctgttgtgacgcctcatagcccgctcccctttactctgccagatagagattcaccttctgtatgatattactgcaggtctcatccaggctcaggccctcattcaggtatttatctccctgctcttttactgcattccagatggtgtcatctgtggaggccggaatctcagctttttccaaaagtgatttcagcttatccagttcttcctcctttggccagctcatattcagggatgacatatttcctgaagcgtctgacatggtaatggaagcacctcccccgtctcctccgtatgtttgttttccaagctccagcgtcttctcatagcccttctgattaatggggaaggctgtacttaatgtgctctgtacttcctctcccagcagtgccttcaaaaagtccgctgcaagctctttctcgctgcttttgctgctgatccccacatttcgatagggaagatatacactttttccctgggctttcatttctgcatagtccagatcaaaggcctggttcacacccagaatctctacaagctgccccactgagccgatccagcctgcacctgctttcgatgtctggctcagcagtgccatggcctgcaggcgcagtccgtcaatgtcggataccacaccgtttgcagcactgaaatacccgatggaattttcctgctcatcctgggtaaccggttccccataaatagttttcatgttttccaggaaagttctcagcgcctcttcatccagagttccgtcctcttttttcaggtctgtgctctccagacgatagaaaatttccagaagcatttcggaatccgtgggtattatgacacgccctaaatccgggttttcctctctaatgctgccaatctcctcagccaatgttttcagactttccgctgcatttacaagagactcctctccctggacagccgggatcaaaaagcccaggggaactgcataaattttgtcatccctctcataggtcttcataatgttctcaaacaatccgtcttcctgatctgctgactccaccgtatccgttatatcctccaaaagtcccttttggatataattctccacaggcattccgtccagaatcaaaatatccggtcccttgcccgccataatgtctgtattcaaagtgcggagtgcatcggagactgtaactgaatcttcaccgctcataccaatttccagattcacatagacgtttggattctgactctggtatacggaaatcgcctgtctcagcacagggcagtcctccagagaatataccttgatctccttctccggcacggaggatgtatctgcggagtaagtatagcggtaaatcttgtactctgcgtctatagagcacgccacaagaaagctgtcatcctccataactgccagagatatgagcatagctttgggatttcctatggaagcaagacttccattgactgcctgttccaccacggtaccgccgaaaacatgtctgtaaatgccgctctctgcacagtaaaacagcatatcctcctcttttccatggccaaagaccacactgtttcttaacttattctgctcactctcaagctcacttaatagctggtcagaaagcgttttgtccgcttcggcggactccccggtattcatatcataggctttcagtcccttgtcagtgagaagcaaaagggtattccccatgtccgctgtctgctgaacattatcactcaattccattgtctgttccacatgcccggtgtccgggtcgatcacacacaccgttccataggtatatgtggcgatgagcttcttaccttcagaaaatctcagcccggtgatcattttcatattgtctgtttcctccacgtcaagtgtcagattctgcagttctccccccttttttgcatataagagggaaaagttctgggatacgactacctctgccgcctcctgcatggcagaaacagcaatgtctccactcccgctgatacaggcccaatctatgtaggcacactcggaaagcctgagtccttccggcaggatatcctcctcccagctttttcctgaatcctctgacttccacagacagcgttctcctgtgtccttatcctccgtaaaaagtgacaggctgttgtcatccagtctctccatggccaggatcttacctgtgttcccggggagggctatatcctcctccagataacgtcccttagcaccttccgtgctcttatcctcactttgtttcccgcatcctgcaaggcctgccacagcaatggcgagagccgctgtcaggcatactgctttttttatgtatcggttcatgtttctcctcctgtctctcatttgcgtttatcttatcattccattctctaaacattctctaagatcatctctaatttttcttaaatttttagagataacttaaagattcctgtgttatacttcaaataaataaaaaaccggaggatttatttcttatgaggattttaataatagaagatgaccgcaaactctgcgattccctgaaattccagctagaaaaggaggggattctcacggatttatgttatgacggagaggacgggctggattatatccggcagcgcacccatgatctgattcttttggaccgcatgcttccctccatggatggacttaccgtcctggagaaaatgcgctgggagggcatttccacacctgtcattttagtcacagcactgggagagctttcagataagatcacaggacttaaccaaggagccgacgattatctggtcaagccctatgattttcaggagcttctggcacgtatccgctgtatcacccggcgcccgggtaatctggagatgtccggagatatcacttttggagatgtcacttaccaccccgcacaaaaacagcttctctgcggttccaagacactggttttatcaaaacgagaaggcgcgcttctggagtttcttcccagaaacccgggccagacccttccacgtctcatgatcctgtcccgcgtgtggggacccaacgcggaggtggaggaaggtaatctagacaactatatccactttatccgccgacgtctcaggaccgtgggaagcgcccttacactgcgcacagtccgggggatcggctactgtctggaggtgagccatgattagaaaagaagggagaccgccacacccacccttggtccgtaaaatgcgtatccggctcactttgctctgcctagctgtcacaggactcattctggctgctgccacctgcctgtgtctctacttttccgaatccgggatcgcaaagaacggaagcacttcctttaccaacagtttaaattccattctcacacatctggaaagccaaaataccatcacactccagtggatcgcaggcatagagcaaaaccatactaccatcctctcgctgtatgacaatggcagacctcttttctatcaggagctgcgcagaacgcaggaggaaaaggatgccataaccctggcaaaggagacggcatcttccagatacgggctggatctggacgcggcagacgcctcctcccttctgtcaaaacacgtggaattccaatttaagaccaatgacaggaaagaatatcacgcctccgtggtactgctgcccaagacaaacggtcatttaagcgctgttatccttcagtctctggatgcccagaaaaatcagatcaacagacagcgccttgtctttctgggtgcggataccgcggcgctgctcctgcttgccgtctttttctggatcttcatgggaaaaaccctggcacccctggaggaaaaccgcagacagcaggcccagtttatcgcctccgcctcccatgaactccgctcccccctggcggtcatgctctcctgcctgactgctgcccagaaagcagagcccgaggaagccgcccgctttacagaaaccatccagacggaaggaaagcgcatgtcacgcctgatcgatgacatgctgcagcttgcaggcgcagatgcctgttcctgggatctcatgcccgctccggttcccccggataccttattgctggaaacctatgaaaaatacgaatacctggccagggaaaaagggctgacccttcatatccgccttcccgaggaggaatgccctcctgtgctgtgtgatgaggagcggatcgcgcaggtactctctatccttatggacaatgccctgagctacacgcctgcccccggcagcattacactttccctgtcttttacttccggccacgtttccctgtccgttgccgataacggcccaggtataccagattcctccaaaaaacaggtgttccagcgttttttccgccaggataaggcccataccagcaaagaccacttcggacttggactcagcattgcccgggagatcgtaaggatacacagagggcggcttgtcctgtccgacacaccgggcggaggggctacctttaccataatattaaggacagccccggcctgattctgcttgcatcctgctatcatacggattataattattttgtcggcagactgtgcggctgccatgaggtacaaccgcacacccacaataataaaataagatacccataaaaaggaggactagaatggagaaaatcgcaagctttaccattgaccatataaaactgcagccgggcatctacgtatcccggaaagatcatgtggggaacgaagtgatcaccacttttgatatccgaatgacttcccccaatgaagagcctgttatgaacacagcggaggttcacaccattgagcatctggcagccactttcctgcggaatcacaaagaattcggcagcaggatcatctactttggccccatgggatgccgcacaggtttttatctgctgctggcaggggattatgaatcttccgatatcgtggaacttttaaaagatatgtttgtatttatccgtgattttaaagatgaggtgccgggtgcttctccaaaagactgcggcaattatctggatatgaatctgggtatggcaaactatctggcaaaaaaatatctggacgaggtgctgaaccatatcggcccggaccgtcttatatatcccaactaaataagagtccggctcgccggactccccttttaaaattctcccatctcttcgctgtaaaagcaataactgtccttgccggactcttttgccttgtaaagcgctacatccgcatattttcctatggaatgtttttcttccggacagtgcctcggatagaaggcaacccccacagacaaggacaactgcagtcctccgaactcttctttttttacatgttccagaatattctttaagacaggctccaactgctcttccctgtcgatcccgggcaaaaacatacagaattcatcgcctccatacctagcggtgatggttccctcaggggcaagctctgtcagtatcttcgcgattttcatcagcgcaatatccccataggcatgtcctcttgtatcattgaccagtttaaaattatccacatccatcaggcagtatgctccgacccttccgtcctgcatgatataggaaaatactgcccgctcaaatgcctggcggttcagcaggtttgtcatggcatcatgggacgcctgatgctgcatctccagctcataaattttcttatcatggatatccagaatcgctcccacagccccgcctgctccgtgaggaagcatcaggctcatggtaaaccagcggtattcccggttaccctccggccggagccggaaatcacatgtaatattctctctcttattcagggatgcgcttctcagcgcctctatattaaacttctcatagaggtctatcttctcttcttcatagacattgtctaagataaactgttccaggaatttctcataatcgtacaggattcccgcctttagattgaccgacagagaacctgtgtgaaaaaataatatctggttgttcttaatatccacctcaaaaattacggtatagaccaatcctgccaccacccttcaaaattaccgaatatctattatattacgtaactgttcagtactcttacagttacgagcaaaaatccatgcaaatcgcctttggcgatgggatttttgcccggctgctgaatgttttcttacggtcagcgcagtaaatgcgcagacctactgaataattactatattacaacaatataacactattgtaaaccataattgttggcttataattttatccctattagggcataatatagtgcatatacttgtacagggtgaatccgcacaatataaaaaatggcatctgccatatttgtcatgttttatgcaatgtcggatatatctcatatttggaagggaaatttcttatgaacatcggtgaaaaccttgcgaaactccgtagagataaacagataagtgtctataaactctctcaattaagtgacgtttccatcaactatatcagaagagtggagaagggtgagagcattcccagcatagagatccttaccgcgctgttgtccccccttggaatgcatctctcagaatttttcaacgaggaatccaatatactttatccgtcacctcatgaggcagagctgatccgtctctaccgccagttaaatgaggaacaggcccgggcacttcttgatctggcgaaacttctcgcagaaaaatgagcagaaagtatgcgctatgcacaccttctgctcatttactcattctatctttctgtcacgcagagactccctgctgtcatagtcgtgaagctgcagcacctctcccacatcacagagaaacacatcctccggatgtcttttcaaaaccttctttcctcctgtatccccttcaagccccatcagctccggaatatagttttcatgaaagatcaccggattgcctgtggtatctccttttgccagacagccgatttttttaccgcttttcaaaaatccgtccagaaaacgattcactgtatccgccctcagatggggctggtcagccacaaaaaagcagtaaaaatgttcctctgtcttttcagagccgcccgctttcctgctctctctgatccccagcttcaaggaggaggaaatgcccagagcactctctctattctcaacagggcaaaaaccgttttttgcggctgcttccaggatcagcccatactggctcaccacacagacagagactatgtctcttctgcactcattcagcactctgagaacctccatgggatactcatacatgggtctgccgtccagttcatagagcagtttattctccccgaaacgtctggaaaagcctgcggccagtaagatcaagtgtattttcccattggccgttgtagggtcagagggccttgcgtataccgatacactggtatgttcctgcatttcttccaccgctttcctgtccccggtctggttcagcaggattatctgtgccgcccctggaaacttctttttaagcggctgaacgtatccggattccagcagatgtcccgcaagtcccggtgtcagcaccagatccggacacagcatgtctcccactgtccctttttccaaaagcagtttttccgcctcctctatcctgaagcagatatccctgagaggtctgccaactgccggcatgccggccagtatcataatatgtgtagtctcattaacgatcaccggttcatgggcagccggaactttaaacggatgccgcttagagccatccgcctctattatgaccgcatcaaaaaaaggcagcactgcggaaaacaccgccttgggcagagctttcattttcattcccccggggccggatgtcccggcagtcacgatcagggatttttcaagggcagcccctatctcttccggggacttatctataactccgtttcttcccagaaaaccgggatgttccatatgggtggtagtggtcaccagcacctttttgccctgccctgccaattcctcggccaacagataagcgcaggtggtcttcccccctgcgcccacaagggagatcaccggcttttccggccatttccctgtacttttcaacatttccaataaacttttattcatctcagtacacccttttcaaaggcacttaccagctccagtacactgccggcaatacatctggctttatctgaaatcaatgtacagtgtgctctggattcctctctggggtccacatctgctgatttaaaatgcgctgtcacccggtagccgtccggcaggatccccctgagcacaccggaaatcaccgttttctggggataacgctgcccgtccggggtttccacatatcccaccggagttcccgcctccacccagtcgccgatagaggcattcacccggaagatgccggcccggtcagaatggatcactctctcttttccatagccgcctatcataccaggcacccctgtattcgctatggcacagcctgtcttaagtattctgcccagatagtgccccctctttgtctccaccacatagtccacatcacgtcctgcttcaaatccaggcccaagggcaatggtcagttctgccatatcccttctggtgcctagattccgctttgccagaatcccatcaatcaggatctccggttgcagaatagcaagggaactacacgcagggtccaccaaaagcaccggggacatgggagccgcagcagcgagcgcctcctcggcactctccgcccttttgcacaccatgccctccacttctgtctccccatcataaactgcctgggaaaaagccacgagccttcggattgcggaaggtctgtcagtctccagtatgacaacagggtatccgcttctgccaaggcggtggatggttcctgttgccaagtcgccgccgcctcttactacaattggtctcatgatccgttctctcctaaccgtaaccgctcaggcaaactgaatggttactcctaacctgcttttgtcattgtcctatggacgtatgatcttatctgcgtctgcctgtttttccacaatttcatacatattggtcgctctgcccacagccagtttttccccgatcccgtaatgattcagacaggtcccacaggtgagaatctccacaccttccctgtccagcagcttcagatcctccagggactctgaatcctcacaggacagatgtgcgcctccattatataaaagcactgttttgggaagtacgggaagctgtgtcagggcatagataaatcctttcattaggattttccccaataccgcgtctccgtttcccatctcttttgaggaaatcaccactacggtattgtccccggcgggaaccgcacagtttacagggatctcctgctctgtccggtcttctctttcactggtcactgtgatccttatactgtattccttttctcccagcttttcggaggcatactctgcactctgtgacgcagccagcttgcgcagattttccacagccatcacattatccactgtgatgaggacaacatcaccccggttacatgtatctatcgccttttttgccaggatcactggttttgggcaggccagcccttttgcatcaattctctgctccatatgtcaccttttcctcttttcttactgaggtgccgtatatttttttctgggcacatatctgcccgccttttcaatctgtactgcacctttgtctactacaagagtaccatgcaaatagactttgtcaatacatccttttatttttcttccctcaaagggagcataatccatggcatagtgctgactttcaacagagatcactgcctctttttccgggtccataacgaccagatccgctgtacttcccggggcgatgcagcccttctccgggtacattccatacagctttgccggattctcagacagaaggcggcacatctgctccagagagattttaccttccctcaccccataggtatagagaagtgttccccttgtctccacacccggcataccgttgggtatttttgtaaaatcctcttttcccatggccttctgctctgtggtaaagctgcagtggtctgtggaaactgtctggatccgttcctctttcagcgccttccaaaggcattcctggtcttttttcttccgaagaggcggagatatcacatattttgccgcctcagcaccaccctgttcataaagactgtcatccatgagcagatactggggacacgtctccgtgtatacctcctgcccctctgccctggccttctcaatttcccggtatgcctcctcacaggtcaggtgcacaacaataataggagtacccgcagtccgcgcagtcaccagcagtcggtgcacagcctcagcctcaagccgggcagggcgtactttgggatgtgtatcggaatccaacctgccctctttttttgcctcacggatcagggcgtcgataatatcagcattctcacagtgtactcccgcgatcccgcccatgtcctgcagacgtttcagaacctcgtatatctcaccgtcattaagcttcattgcaggatatgtcatatacagcttaaaggttgtcacccctgcctttatcatatcctcgatctgggcagcagtctcttcgttccagtcggaaatggccatgtggaaaccgtaatcacaggaagattttccatccgccttcctgtgccagttttcaagggcttcttgcagggtctcccctttattctgtgttgcaaagtcaaccaccgtcgttgtccctccggctatggcagcaatggtcccgctggcaaagtcgtctgccgttacggttcctgatacctccagatcaaaatgggtatgtgcgtcgatgaatcccgggaataccagtttcccttccaggtccaccgtctcatcagcctccccagacggtatatccttccccactctgcatatggtctccccgtcaatgagaatatcctttcttccgctttcctgtccgttcacaactgttccgttctgcaaaagcagcttcatatggcctcatcctttcttcttttctttcctgtaaaatgtattttcaaggggcagttttctccgctccactccgtccagtctgtagtaggcatgtgcgcatgcaggtgctgtgggcactgtggaaatctctcccacaccctttgccccataagcctcggtcagcacttccggggaagtgaccagaatagatttgatatccggcgcagcggttgccctgaaaagtcccagctttccgtaactcagcaccggccttccgtccaccatagggaagtcctctgtaaatgcataaccaagccccataactacgccgccttccacctgtccctcacaggactgtacattgatcaccgtacctacatcgtgtgctgccgccacctctgtgactttcccgctctcgtccaggatcaccacctgggttgcatatccatatgcgatatggctcacaggatgttctttctctgaacccatggcatcggtcactcctgtatactccgcataaaattcctgtccctccagttcatccagggatttcttatcctgcagggcatcctttaatttaagcgctgcctttcgtgtggcctccccagtaaaaagcgtttggcgggatgccgtactggtcccggaatccggtgtgtctatggtatttgccttcttatgggtcacctgatcagccctaagccctgtggtttcgcagacgatctgaatggccaccgtgcctactccctgtcccatgcaggccgcggaggtgagcacctggacttttccgtcccgaatcctcaggctgcagcggcctatgtccggattcccaacaccgatcccgctgttcttcatacaggaggcaatccctgcatagggatgggaatcatatacttcctttactgcctccagtgtctgtgccagggcacagtccggtgtggcaatctggccgtttggcagtgtctgaccggggcggatagcatttctgtagcggatttcccacggagtgatgcccacctgctctgccagcaaatccagattgaattccgtggcaaagcagctctgggtcacaccaaatcctctgtatgcacctgccggaatattattggtatatacaccatatccgatgatctccacattctgataattataaggtcctgccgcatgggtacaagctcgctccaaaaccgggcttcccagggatgcgtaagcccctgtatccgcatagagcacagccttcattcctgtcagatatccgttttcatcgcaggctgtggtgaagtccatctccatggcatgacgcttcacatggcacatcaggctctctgcccttgaaaagcggaccttgaccggccgtttcagaagccaggcgcagagggccgcgtgatgctgcacactcatatcctccttgccgccgaaaccgccgcctaccagcatggattccacgatcaccttctccgggggaatctgaaggatccctgatatctccctctgttcatcgtagacagactggcccgaagtatacagatgtacgccatcctccccttcgggaaaggcaatagcgcattccggttccataaatgcatggtctgtaaaaggaagactgtaatggcgtgtgacaacatattttgaattcttcacagccgtatccgcgtctccccggatacactgtttcttagccagcagattgccctcctcgtgtactttcggcgcatcttcctcaagtgcctttctggggtctgtcacaggctgcagttcctccgcatccagttctatgagacccagcacttcatctaagctttccctgtggttcaccacagcaagggccagcgcatcccctacatatcttgtgatcccgccttcagggatcatgacatcccaatccttcttaatatgtccgcaaatattctccggcacgtcttttgccgtatagacagccacacagtccgggtgagccagtgcttttcctatatctatgcggttgatccggcatctgggatacggagagcggagagcctttgcataggccatatccggcaggacaatgtcatccacatatttgccggttccccgaaccttctcctccgcgtccacacgtttgaacctgcgggttataccgccttcttcctcttcctgtggtacttcacgtttttctctgaaaaaatccgctgccatgagaatagcgtcctctatcttcttatatcctgtacagcggcagatattgccgtggatcgccttcttcacatcctgtctgccggggtttaagtttacatccagcagggattttgcggaaatgatcattccggggatgcagaaaccgcactgtaccgcaccggcttccgcaaagcagtgaacatataccttcatctcctcttccggaattccctccacggttgttatatgcctgccgtccgcttttgacagcttgactacacaggccttcatctttttcccatcaaccagcacggtacaggttccgcaggcgccctcgctgcatccctccttgactgctgtcagccccagttcatccctgagatagtccagaagcctgccttccttttcacttctacactcttttccgtttacatagaacgtatacataaaaacctcccatccggaacctcctatatggttcctttcccttttcctacaccaatacttcgtaaataccctcatacaggatttcccgctcctgcatcattttctccgttctctctttttcctgaacctctgtacaccaggacaggccgcatccggcagaaactgctctcggaagagggatcagtctcccgggaagcccctgttccctgcacatcttttccattgccatggccctggtggtggttccgaacgtaaccaccagctttaatgttctctctctcatgtctctgtctcccttgcagcagtccgaacaaatggatcttactgctcttcttttcgctgtaaatgtggctttgatatcctaactataacacctgcagacccttattacaagggattcggagcactttttaaaaaatattttagataacctaaaaatttttgtaaaaatctcttgcaatctcaaaaaagtatgctatgatggaattaacaagaaaaaggaaaacctgtcagaaaggagctttctcatgggcagattgaaattactgaaacaggtggcagacggccttgtcagacagttcgggccggactgcgaaatcgtaatacacgacttaaagaccaaagacctggaacactctatcgtctatctggaaaacggtcatgtctccggcagacaactgggagacggcccgtcaaatgtggtgctgaaagcattgaaggaaacacacccggaaaatctgacggacagaaccggttatctgacccggacagcagacggaagggtcctgaagtcttccactttctacataaaagatgaagctgaggagcttcactatattctgggtattaattatgatattaccaagcttctcaccttagaagccgccatccacaatctgactgacacagatgaggaaaaagaaaaagaggccgctcctgagatcacccacaatgtgaatgacctcttggaccacctcatcgaagaatccgtgaatctggtaggcaaaccggttgcactgatgaccaaggaagacaaggtaaaagccatccagttcctaaatgactccggcgctttcctcatcaccaaatccggcgataaggtggcaacttattttggcatttccaaatatactttatacagctataccgatgtgaataaagaaaagggggaacaaaaaaaatgaaagaaatccaatgggcagagaaccgtatgccgaagacggcagacacctctcttccgatcatgtcactggaaaatgtagcaaaggccagggcatttcacgaaagctttccgcagtacagcaaaacaccgcttgcaaagcttgaccacatggccgaatatctgggtcttggaggactctttgtaaaagacgaatcctaccgcttcggcctgaatgccttcaaggtactgggcggctccttcgccatggcaaactacattgccaaacagacccacagggatgtaagccagcttccctacgcggtcctcacttctgaagagcttagaaaagaattcgggcaggccacatttttcactgcaacagacggcaatcacggacgcggtgttgcctgggctgccaacagactgggacagaaatccgtagtcctcatgcccaaaggctccacacagacgcggcttgaaaatatcctgaaagaaggcgctgacgccaccatcacggatgtcaattatgatgaatgcgtccgccgggcaaacgcaatggcagagcagacgccaaacggtgtcatggtacaggataccgcatgggacggctacgaggaaatcccctcctggatcatgcaggggtacggaaccatggcttctgaggctgacgaacagctcagggaatacggctgtgaccggccaacacacattttcatccaggcaggcgttggttctcttgccggagccgtacagggatatttcgccaaccgctatcctgacaacccgcctatggttgtggtgatggaagctgattccgctgcctgcctctacaaaggcgccaaggctgctgacggcagtatccgcatcgtggacggcgatatgcctaccatcatggcaggccttgcatgcggagaaccaaacacgatctcatgggatattctgaaaaaccacgtgtcagtatttacctcctgccctgactgggtatccgccagaggcatgcgtctgctggccgcccccgtaaagggagacccacaggtgacaagcggggaatccggagctgtaggcatgggacttctgagcgcagtcatggaacaggaagaatacagagatctgcgtgaactgctgaagctggataaaaattcaacggttcttctcttttccacagagggcgatacagaccctcagcgttacaaagaaattgtatgggatggaaaacaatatgattaatggttcctgttcacatgcatagttagaatatgaatccccttaaaaaataagggaacggaaacaattacagcagctatcacgatatgaaaaagctgcctaattataaatcaaaaaaatgtattgggaggatattatcatggattacggtaaaatcaaagaagcagcacagggttatgagcaggctatgacaaagtttttaagggatttggtcaggattcccggtgaaagtgttggcgaggaaggccatgtaaaacgcatcgagcaggaaatgaatgctctgggatttgataaggttgtcattgaccccatgggcaatattttaggatatatgggaaccggaaagacactcatcggctttgacgcccacattgacaccgtaggaatcggcaaccgtgacaactgggattttgatccgtatgaaggctttgaatcagacacagaaatcggcggacgcggtacctcagaccagctcggcggcattgtctccgctgtctacggcgccaagatcatgaaagaccagggactgctggatgaccgctatactgtgctggtaactggaacagtccaggaagaagactgtgacggcctgtgctggcagtacatcgtcaacgaagataaagtaagaccggagtttgtcgtttccacagaacctacagacggcggcatctaccgaggacagagaggccgtatggagatccgtgtggatgtaacaggtgtctcctgccacggttccgctccggagcgcggtgacaatgccatctataaaatggctgacatcctccaggaagtacgtgacttaaatgaaaatgacgctgaggactccacagagatcaaaggcctggttaaaatgctggatgagaaatacaacaaggagtggaaggaagcccgtttccttggccgcggcacagtgaccacctccgagattttcttcacatccccaagccgctgtgcagttgctgattcctgtgcgatctcccttgaccgacgcatgactgccggtgagacctgggaaagctgcctggatgagatccgtgctcttccgtctgtaaaaaaatacggcgctaaggtatccatgtacaattatgagcgcccgtcctggaccggtctcacttacccaacagagtgttatttcccaacatgggtgattccggaggatcacaaagtgacagaggctatggcagccgcttacaccgagctgtacggagagccgcgtattgacaaatggaccttctctaccaacggagtttccattatgggccgtttcggcattccctgcatcggtttcggacccggcaaagaagctcaggcacacgctcccaacgagaagacctggaaagaggatcttgtaagatgtgctgctgtgtacgctgcacttcccactgaatactgtaaataaggatcacggatcatataaatttttataaaagaaaggatacccataccatgaaaacattacaggattatatcgataaattaaacaaactgaatttcaaagaaatgtacgaaaatgacttcttccttacctgggagaaaacagatgacgagctggaggctgtattcaccctggcagacgctctgcgttttatgcgcaaaaataatatttccacaaaggtatttgagagcggcctgggcatttccctgttccgtgacaattccacccgtacccgcttctcttttgcctccgcctgcaacctgttgggcctggaggtacaggatctggatgaaggcaaatcccagatcgcccacggggaaaccgtgcgtgagactgccaacatgatctccttcatggcagacgttatcggtatccgtgatgatatgtatatcggaaaaggaaatgcttacatgcaccaggtttccgacgctgtcaaagaaggttatgaggacggcattttagaacagcgccccacacttgtgaacctgcagtgcgacattgaccaccccacccagtgtatggctgatatgctccacatcatccacgaattcggcggagtggagaacttaaagggcaaaaaactggctatgacctgggcttactccccatcttacggcaaaccactctccgttccccagggtgtgatcggtctgatgacgcgttttggcatggatgtggttctggcacatccggagggatatgaggtaatgcctgaggttgaggaagtggcaaagaaaaacgctgagaagaccggcggcagcttcaaacgtaccaacagcatggaagaagcgttcaaagacgctgatatcgtatatccaaaaagctgggcaccatttgcagctatggaagagagaactgatttatacggaaagggcgactttgacggcatcaataaattagagaaagaacttctggcacagaacgcgcagcacaaagactgggcctgcacagaggagcttatgaagacaacaaaagacggcaaagcactctatctgcactgcttgcctgctgatatcactggtctgagctgtgaatccggtgaagtagacgcatccgtattcgaccgttaccgcacacccctgtacaaggaggccagcttcaagccatacatcattgctgccatgatcatgctcagcaaatttgatgacccggcagagatcctgaaaaagctggaagaaagagaacagccgcgtaaattcaaataatatgctgtcacaaatgtaagaacagggggtttttactatgcagaaacaaaaaattgtcatcgccctgggcggcaacgccctgggcaatacccttccggaacagatggcagccgttaaagtaacatcgaaagccattgtggacctgatcgaagaaggccaccaggttatcgtcactcacggaaacggcccgcaggtgggtatgatcaacaacgccatggcagccctttcaagggaagatgcagcacagcccaacactccgctttctgtctgtgttgccatgagccaggcttatatcggatatgatctgcagaatgctctgcgtgaggagctgctgaaccgggggattgacaacatcccggtatccactatggtcacacaggttcgcgtcaatgaggatgacccggccttttccaatccttccaaacccatcggaaagtttctgggcgaggaagaggccaaagagatcgctgaaaaatacggccacatcatgcgtgaggacgcaggcagaggctggcgccgcttcgtcgcctccccgaaacctcaggagatcgtggagatcagagcgatccgctccctggtggactccggtgaggtagtcatagcctgcggcggcggcggaattcccgtgacgctgaaaggaaatcatttaaaaggcgccagcgcagtcattgacaaagattttgcaagctgcctgctggctaaagaactggacgctgactatctcatcatccttacagccgtagaaaaggttgccatcaatttcggcaaagaggatgagacctggctgtcagccatatccacctctgaggcaaaaaaatacgccaaagaaggacagttcgcacccggctccatgcttccgaaagtggaagcagccattgatttcgcttcctcaaaaccaggaagaaaggctctcatcactctgcttcagaaagcaaaagacggaattgagggcaagacaggaactgttgtctgtgacaaactttaatatagaaaaaagtaaaataaaaaatacccggcaggcctgcctccgctttgtgcctgccgagtatttttattgcgatcaatatttggaatgtatttatataggttgatgtttctgtatcataacatggaatgtcttatatttacttattaactacatttattggactaccatctgcaaacgctttcaaatcttccactgcaatatccataagtctctgtctggactctcttggcgcccaggaaatgtggggtgtgataatacagttttttgcctgcagcaacggattatcccctctgatcggttctgtggatactacatccagcccggctccggctactttaccgctgttcagagcgtctctcaaatcttcctccacgatcagcggtcctctggaattattgataatgatcacaccgtctttcatttttgctatactctctttatttaccagtccctgtgtggatggaaacagcgggcagtgcagagcaatcacatctgctctggcaaataattcttctctggtcacatattcagcaatctctttaccactatcattggggtattcatcattggcaataactttcattcccagagccttggcaatacgccctgtagcctgtccaatccttccgaatcccacgatccccatggtcttgtcagccagttccatcagcggataatcccagaaacaccagtcggaattattttcccattttccctcatgcacagcctggtcatgatgaccgatatgatggcagatttccagcagcagggcaatggcgaactgtcccacagcagctgtaccatatgttggaatattacaaaccgggatgcctctctctttggcagtatccacatctaccacattgtatcctgtggcaagcactcccacatacctgatattttggcaggcatcgaacacttcttttggaagtggtgttttattggtaataacagcctctgcgtcaccaatcctgtctatgacttcctgcatgtctgtgagggatgtgcgatcataaactgtcagttcccccagcgcttccatatctccccaggataaatctcccggattttccgtatagccgtctaacacaacaattttcatatttttcttatcctttcccaaaagctttctaaatttcaaatctgtggattttccggatgaagcatagttgcaataactttatccagcacttcatctttccagatatctttccagttttctctcattaccagacggttgcccagtccgatcgccactttgcaggcatccgataccggtggatttcccggaatatatcccagaaagtttgcggacagattataaatatgtcctgtcaggaatgaaactgcagcttcctttggaattcctctcttcacagcttcctccactgtctctgccatggcatacagacaggtagcgcccagcagctcaacaagtgtaggttctaaaaacgctatctgttcagaggacattacatatgcatgttccaccggtgcatacatctgttttgccacctccacacactgcgcaaagcgctggtcatctccctggatcttagacataacaatgtcctgttttcctcccattccgccaaaacggtcctgacgcgcctcaaaagtgtcctgatccaaaaaataggacggatggcatggatgagccactccaaatgtacagtcttccctcagagtcagttctcttgcaaccgctgccgccggatccaaaataataaaaccggttcccggctttagctgaggcacataaattgcagacagctttccgatcagagtatccggcactgcgaatactaccacgtccgcttttgccagggcttcctccacaggagtgggttcaaatccacggtctcttatgctttggattcccgcgtccgtggcttctaccagaagcagttcaaacacatccggtttttttgccagattattactcgttcttgttcccattttaccgcctgcgccgattacgcttactacgattctactcattttattttcctcttttctaattcctacatgacatctgtcaaactcttttaaactctgcattttatttctgccataaccgggaatccctttttccactctgcagggattccgcaatgggcagggccctgccggcagctacagattttcttttactgtctttgcaatatcttccggtgagaatccgtaatgatcagccagctctttagccggaccagattctccgaaagtggtaagccctatgcgttttataaatttgggtgcattttctgctgcaagcctgcttatgtacgcccccagacctccattgatattatgatcttccacagtcactatcttttttgatctcttgatttcttcaatgatcttcacaggattctttccgtataaaatattgatatcgcagacagtcacatttaccccctgttccttcagcaaatccgctgctgccaggacgcggtccagaacaaacccgcttgataacaaaagtgtgtcatcgccataatctcttaaaatagtaatgccctccggagaaaatggtgcatctttttcatacacatctgcctctcgcccgctccctgccctaacatatacaggcccgttgatctctgctgccatctgcacagctttataggtctgatttccgtctgcaggtgtcagaatcgtataattgggaatgtttgagagaattcccagatcctcataaaactgatgggtaacgccttctctctctccccctaaaagcccggaattgattcctacgaattttacattcagattcggatacgccacaaaagtgcgcatctgttcacaagcacgcatggtcataaaccctgcataagtacctacgaacggagtcaggcccgcggcagccagaccggcggctgtatccactgcattctgctctgatattcccacttccacgtactgctcaggatacagctctgcaaactttgttgcacgcatagcttttaatgagtcgggtgaaacaaacatgattttatggtcatttgccgcaaggtctataagtgccgcagcaaaagcctctcttgtccctttaaattttcccattattctgcacctcctaattcttttactgcctgctgatactgttcctctgtgggcacccccttatgccatgcattgtcattttccatgaaagagagtccttttccctttacacaatcacagacaatgacactgggttttccctttgcctcttttgcttttgttactgctgccttgatcgcgcttatatcgtgtccgtcaatctcctgcgcattccaccggaatgcctcaaaccgttcttttatattatttgaaccaatggtctcctgcacggaggaaccgctctgccatccgtttttatccacaaatacgatcaggttatcaagcttatgagctgccgcggaattgattccttcccagcacactccctcctgaagttctccgtccccgacgatcacataaacatagtaatcttttttttctgtatttacctgccagtgccatacctcctgcaatggatatgccgtttcccagggacccggaggtcatatcaacaccttttgttttattcatgaccggatgcccctggaatctgcttcccagtgctctcagcttgaagtcctcaattttttctccgaaatatcctttctcagacaatgccgcatagtaaatcggacatgcatggcctttagacagaataaatcggtctctgtcctcccactcaggatttgcaggatctattctcatctcatcaaagaagagcactgccataatgtctgcaatagacaatgccggacccggatgtccgtcctttcctttataaaccatatccacggctgtcattctgagatgatctgccacttgtttcagttctgtgctgttcatactaaaacctccttaaaatttatattttatcaaatactatcaaactcccatgatacctggaagccaggtgataattgccggaataaatgtcatgaccagcaacgccgccacttcgacacacaggtacggaatgatccgtttactgattttgcctatactggtattggcaatacctgaggcgacaaacaggttcactgccatcggcggtgtaatcataccgatggaggtattgataataatgatgatacctaatgcgatcggtgataatcccagagatactgcaatgggcagcaaaatgggagttaccagcagaataatggactgtgtttccaggaaacaccccagaaacagcaaaattacattgatcataagcagcaatgccaccttattggtaaacagccccagaacactggatgcaataagggccgggatattctggttcgtcataaaccatgcaaagggtgctgacatgcttaccacaaacaatacaacggctgagctgactgttgatttacggaaaatctcgtagatatcctttattgtcagttctttatatacaaacacactgatgatgaaagcatacacacaggcaactgccgcagattccgtgggtgtaaataaacctccataaatgcctcccagaatgataaccggcatgaaaatggctaagagtgcctctttaaatgagtgagcaaaggcttttaatgaaactttgctgttctccgcagcatcgtattttttgcagatcacaatattggtggcgatcagcactcctgcaagcagaagccccggaatcacacctgccataaacatggttcccacagatacagaggctgtcaccgcatatgtcaccattggaatactgggcggaatgacaacacccagtgtcccgccggaagctgcaacagcagccgccacatcttccggataccccttctgtttcattcgcggaaccgtgatgccgccgatggcagcaaccgttgccggattggaaccggagatagcaccaaaaaatgcagatgccacaactgtaatacaggacagacgtccgggaatccttctcattaaaatttcaataaaatctataagccgtttggaaatcccccctttttccataatattaccggccagtatgaagaacggaacagccatcagggtgaaattatccgcctgggtaaacattctctgcgcaactgcagggagcagattcagattgccgctggatacaattgccacacacactgcaatccccaggcagatggcaataggaactcccagaaacagcatgacaaataaaactccgaacaatattcctatgatcattctttcttttcctccttttgcccattctctcctgttttttctttttctgtaactttctcaaatgtatgccatacataacaaagagccatcagtatcaatcccagaggaatggaaagatacatgatccacataggccactgcagacttggggtcacctgaccactcgccatttgtttctgcaggatggtaactccgtaataggatgcaaaaatgctgaatgcagccaccagaacagaattcagtacgtagatcactttcagtactttcttagagcaaaacaactccaaagcctccacgcaaaagtgttctccattacatgccgcaacaccgatcccaaggaatatcacccatatcatacagtaccttgccagctcttctgcccatgggatcacgaacaaaccggtgaaacgtgccactgtggcagcaaagataaccgcacacatgacaatcattaacactaccagaagcatttcttccgctttttttagtccgttaaatagcttttccaaaatgtccacctcttctatttagttagatgactgaattttttcaaccaattccctgttcagtttcaggctgtccaattggtcgtatacagcgtttgctgcatccttccacacatctttatccacttctgtcaccgtaacaccgacttccttcatattatccagtgcatctttattgtaattactactgtattccctctggtaatccttggcttcctctgccgctttatcaaaagcctctttctgctcgtctgtaaatccatcataagtactctgtgcgatcatcagtacacagggcgaatagaacatatcaatcatggaaacatatttctgcacttcgtatacttttgctgattcgatgatagcaataggattttcctgcccatccacagttccctgctgcagcgctgtaaagatttcactccatgccattggggttgctgtggcacctaaggtctggtaagttgccatatgtacactgttttccattgtacggatcttcatgccttttaaatcttcgggagttttaatctcttttttgtcattggtcacctcccggaatccgttttcccagaaaccaacgcctttgattccctggctgtccaactgccccagaagggaagtaccaatttcaccgtccagcacttcatacgcatgcgcctcatcttcaaacaaatatgggagatccagcacagcaaagtcagaaacaaaattaggtatgggtccggtggatatcagacacatttcctgtactcccattcccacattttccatcatatctctttcatttcccaactgggagtttggatagatatcaagtgtcatgccgccgtcactgtactcctccagcaatcgctgcatttcctgcaaccccttaacatagtggccgtcaggagctgtggttgttcccacctttaatcgcagtgcagcgctgtccgatcccagcatagtatcctcattctttgcctcactgtctgttgcactgccggaggattgtgctgtggaagtatcggtgctatccccctcactactattaccacatgcagtcataactcccactaaagtcacagccagcagaactgctaaaatcttgtttttcatgtctgttctccttttctctcatttcatttgtagttcgttaaacgtctgatgttttatgtatatcatttatcgacttttttgtcaataaaatttaaatatttttttcatatacatgtgcattttgttaaaaataaataaatttaccatatgaatattatgcataatatcttatatctaatatttgacgtatgatgttttcccatgataagatagaaacaactgctaaacatttatgacttttgaaaatttctatagatttgagggtgaaaatttgagtaatttatttgaagcaagcaaacgggaatcggctgtggatctggtcgtgaacagtatgaaacagctcttaatggaaaggacattaaaaccaggggataagctgccaagtgagttggagatatccgaggaactgtgcgtaagccgcgggtctgtcagggaggccatgaagattctttccgccttcgggctggtggatatccgggtgggaaacggcacatatgtatgtgaaacaccgggaaataccaccatggattctcttctgttcagtttctttatctccaatccgcagattgatgacctctatgagtttcggcatatctttgaaaatgatattcttactatgattctggaacattacgatgaaaacggaaaagaaagaagggctctccgcgaaaatctggagcagttagaacgcctgatggctgatggagcttccgacaaaaagctttcggaaaatgatctggaattccacaggcttctaggccaggcatccaggaacctattggctgaacgggtttataatttcattatagactttatggaaccctccattgccgccacccataaaggacgcagtggggaaatcgtctatgatatccatcatgatatcgtgaaattgatcgaatcaagagacgccggaaggattgatgaggttatcacaaattctgtagatacctggtccatacttcagccctctctgaatccatggggtgaataaagatttcttcccatttgtttgacgtataatgttttttttgataaaatgagtgttatcaacaatgatcggggtggaataaagtatgagtaatttgtttgaggccagcaagcgtgaatctgctgtagacattgtagtaaacagtatcaagcagctattgatggaaagacgtctgaagccaggggacaagctccccaatgaactggaaatatccgaagggttaggagtcagccgcggctctgtcagggaggccatgaaaattctgtcagccttcggactggtagatatccgggtaggaaacggcacttatgtatgtgaaacaccgggaaacgaactgatggattctcttttattcagtttttttgtgtccaaccctgacatttccaatctctatgaatttcggaaaatatttgagacagacattcttgaattgatcctggaacactacgacgagaacgccgcggaacgcaaaaaacttgcagaaaatctggaagagctgaaagcactgatcgaaagcagcgctccccagtccgagataacagaaaatgatctggaatttcaccgcctcctgggccttgcctgccataatcagatcgcagccaggatatatgcttttgtaatggactttatgcaggcatccataactaatacccacaagcatcaaaatggtgaatacgtctataatacccacatggcggtttatgaagttatcgagaacagagataaggaccggattgatgaggttgtggacaagacagtggaagtttggtttaaacttcaggattaaaaaataccctctatgaaaggatcaactcatagagggtattcttgtataatggcttcagtcttttgaaaccaataaaatctttttctcaaacccgccccgccgccggcgtttttcttccctgacagcatgcagcttttcaacggtatatcccctggcttcacaaattgcgtagataacctctaccacgtccgccagagtgtgttcgaaaattcttactctcctgatattccgcaatttcctcgtcaagctttttgtcaagctcagagatatacgatgccgctgacagaatttccgtccgtggctgtccgccgtcttctcttatgatatccggaattttatcccgcaccagcttgttaaaatttttcaatacctaccacctctccaaatactccgccctttccggacggtttttctctcccttaaaacaacaaaaaacccttgaaaattcaagggtttccatcgagctgcctagcggatttgaaccgccgacctccgccttaccaaggcgacgctctaccaactgagccaaggcagcattccttgtgatgtcctgtgtagttcgtcatcacaattaagaattttaacaaaagttgtgtcaaatgtcaagatatttttgaaaacttttttatttttttgtcgtatccggttactgttccctgtgcgatgtccgaattccgcaccgcacagggcattccatacccaatggctttattttttatttccgctgcaatatcccgcctggaaatccataacattcctgagtctctgtccctgcatgtaccgcttcagattctcagtgcagatattcaccaccttatccagagtttccggaagatgataaaagcctgatatatggggcgttataaacacattgggataatcccaaagcctatggtctgcaggaagaggctccggctttgtcacatccaaggccacgccggccagacgtccttcatccagcacctcacagagttcctctgtacagactgcatcgccgcgtcccccgttcaaaaagaacgcacccggtttcatgagatgaaacatctctttgttgaacagacctcttgtctctgatgtacttggcaaaaaggaaaccaccacatccgcatggggaagcagttctctgcagtccttcatcagatggggctcatcaatatactccggacaatttccgggattcttcttaacaccgatcacataagcccccagggcatgtgccattttagcgaaatggcggccgatatctcccattccaaagataagcaccgtggaatccgcaatggatgtcacagttccgtgttcgtcccagatgtgcttgttctggctgtcacgatagagatgcagtttcttctgcatggccagcagcatggcaaacatatgctctgatactgtttttccgtaagctccgttggatgttgtgacaactgtattcttatccagaataccctctcctgcataggcatcagctcccgcagaatttagctgcagccactccagttttttggaagcccctattttatctgcagggacattccccagaatgatatctgcttcctgcacctgctccctgctcacctctttgatggaggaatacacaaaacggtttcccggtgccgcctcctccaaaagctctctatgttcttctctcacaggtattactaccagaattgttctttccttcatgttgctacctcccgtcttttctgctgtaacactttacttccctctattttaacagggcagaggattttcgtcaatcagatggagtgtggtattgccgattctatggttttccacagagtataccttgacccgtacgcccaaaaattcgcactcgaaccgctcaccgttcttcggtacccttccgataatgctgcagataaatccgttgaaggtgtcgtaagtatccgtaggaaggtggatccctaaggcttcggcaacgtcatccaagggtgcgcagccctgtatcttccactctttctcaccgattttctcaatttccttcggccgcagcggctcctccgcttcataaagctctcccacaagggcttccatcaggtcgtggagcgtagcaatccctgaaacaccgccgtattcatcaacaagtacagcaaaatatgtcctgttctttttcatattggcaaagagcacatctgctttcattccatccggcacaaaccatgccttatctacagcctgctccatgacagcctcgcgtgacctgtccttcatgcggaaatagtccctggtatccaggattcccacaatatcgtcacagctctcaccgcacacggggtaaaaagaatgacggctgtggcatattgtgtcctcccattcctgcatatcatcctccagatacaacgcatccacatcaattcggtgggtacagatctgctccgcatccatatcgtcaaaatcaaaaatattctggatcatctcattttcctgggcatcaatggttccttgggcgtttccttccatgagaagcatgcggatctcctcctcggaaaccttctcctcctcttcctccggattgatccccataagtttcaagatcaggtttgtggagactgtcagcagaaataccaggggtgcaaatgctctggacactgtatagagcatacccgacatggacagcgccatggaatcggcctttttcatggcaatcctttttggtaccagctcaccaaataccagattgaaataagccagtatcagtgtgatcagaaataccgctatggatttcagcactgattccggaatggacacccctgctgcgatcagcttacctactaacggcccggcaaaattttccgcagcaaacgcacttcccagcagtcctgccagtgtaatggcaacctgaatggtggccaaaaacctggcgggctgttctgtcagggcggacagcttcacagcccttttatcgccatctgttgtcagcttgcgcagccgtgtctcattcatggagatcaccgcgatctccgcactggcaaatgtagcattcaaaaaaatcaaaataacctgtaaaagtattgctcctatcataactcatatacctcctaaaatcgtactatggaattttccctcataaattcggggtttaaaaaaacacaaaaaggcacagcctgtatccggattcctccgtatacagaccacgccttacctatccataatacgacatggggcagctaatctgctatatgcactatcactatcgtcgctatcctccatgtgcgcgatcacatcctttcaccttattgtgtattaagataccaccaaaatgagcgcctgtcaatgctgttatttttttaacattatgtggctgcttactattcagcctttcggctttataacaacaaaaatatgcacacagactgcaaaagtcctatgtcaaaccgcctttggcagtccttctactctaagaattctctgatcttccccctgatcctctgcagggcattgtcaatggatttggggcttttctccatggcctccgcgatctgggtatacgtcattccctccagataagagtccagcacctgggtttcaaaggaactcagatgctgcctgatcttctcctgcatgacattcacattctcccggtctatgacaatagcctcagggtcctgctgctcaaaagccaggctgtccagaataggactctcctcctcactcagagatatataggagttcaacggcttgtttttaagccttccggacatctctatggctttataaagctgacgctccacacacagattggcaaaggtggaaaagacagcacttttccccggctgataatctctcaaagccttgaataggccgatcatgccctcctggatcaaatcttcccgttctccgcccacgataaacatggcatgcgctttcttcagcaccatccccttgtacttttccatgagatagtcctccagctcctgctcaccgtccctcagccgctctattaattcttcgtccgtaaattgttcgtaattttccatatcttatcccaaaagccgctgtctcacaatttcataggccaatactcccgcagcaacggaagcatttaaggaatcaatatcccctttcataggaatggatgccacaaagtcacacttctcttttaccacccgggatacgccttccccttcatttccgatcacaagacccatgggtcccttcagatcaagctgatacatgctggtaccgcccatatctgcgcagacaaaccacagcccctcttttttcagttcctctatggtcctggcaatatttgtcactctggccacaggtgtatagttcagggcgccggcagaagtgcgggccacggtggctgtaaggcccactgccctgttcttcggtatgataaccccgtgggcacctgccagattggcagtacggatgatcgctcccaggttgtgagggtcctcaatgttgtcaaggatcactacaaagggagcctctcccttctctcttgccttattcagaatgtcttccacctcagcatagtcataagctgccgtcacggcaatgacaccctggtgctttcctgtctcagacatctggtccaaacgttccttttttacaaaccgaaccatagtatcgtgttttttcgcttctctcaaaatggtacggaccggaccgtcttcacatctctccagcacgaacagcttgtccaccacgcggcctgaccgaaatgcctccagcaccgcattgcggccttctactttactctcctggaatttctcttccatctgtttctccttcttccaaacctatttttatcagctccagcatacgttcccactgttccgtgagatacaggtatcccatgagcgcctcaaaaccggttgctcttctgtagtctgacatgctggcatttttcgccatagtataagatttcgcgtttctgccccgcttgtacacggctgcctcctcctctgtgaggtggggtttcagcttctctatcatggatgactgggcagatgcctttacaagcctgctggcgcggttatgcagcttatttacctgcgtattgcccttttccaccagaatggtacggatgattagctcgtagatggcatctcccatataagccagagtcagaggagaatacgtacggatatccgtatcctccaggccaaacatatcttttaacttttttaagctctcttccattgtacaccttctcttgtgtcttttaaaatgatgcccatggaggccagttggtcacggatctcgtctgcacgcgcaaaatcctttgcctttctggcagcctggcgctcttcgatcaggctttctatcacagagtcaaggacctcttcctttttattcaccatcagcccaagcacatcacacaggcctgtgatcttatcaaagagcagttccgcaaatgctttggtgctgctgccgtccacctgagtattggtgaattttacaagctcaaaaacggctgcgatggcatctgccgtattgaaatcatcctccatggactcctcatacttcttcacaagcccttcgatctccggaagcattgctttctctgactgggaaagctcctcaccctgggcactttcaaggagatgttttagctggtccacacaggtcacaatacggtccagtgcattcttggatgcctccatcagctctgcactgaagttgaggggacttctgtaatgggcgttcagcatcaaaaagcgcagaacctgcaggtcatatttctcgccgatctcacggacagtaaagaaattccccagagattttgacatttttctattatcaatattcaggaacgcattgtgcatccagtattttgcaaaaatttttccattgcagcactcagactgggcgatctcattctcatgatggggaaataccagatcctcgccgcctgcatgaatgtcaatctcctcacccaggtatttttttgacatgacagagcactcaatatgccagcccggccttccttcgctccagggagatacccagtaaggctccccttcctttttcggcttccacagaacaaaatccagaggatcttccttctggtcctctcctgatacctggatggaacgaaatcctgactgcaggtcatccagattcttgtgggacagcttaccgtactccttgaaattctgaactctgaaatataccgtaccattcaccgcataggcaaaacccttgtcaatgagagtctggatcatttggatcataccatcaatttcctgggttgccaggggatgtgtggtggcgggctttacattcatatcagccatatcttttttacattccttgatatagcgctcagaaatctcctctgcgggaaccccttcctcgatggcttttgcaatgatcttatcatccacatccgtgaaattggatacgtaatttacctcatatcctttatactccatatatcttctgacagtgtcaaatacgatcataggccttgcatttcctatatggataaaattgtatacggttggtccgcacacatacatttttacttttccttcctctaagggaataaaatcttctttcctctttgtcagtgtattgtaaatcttcatgtctctactccttttcttctatcaattcctgaaatgcgtattccagcttctgcagctttgatttcagattttcattctcactctgtagtttcctgatatcctccaaaaccgggtccggaagatggatctggtccatatcacttcttggcaccttctgattctcccgcttcacaatacgcccgggtacgccaaccacagtacagttgggcggtatctcctccagcaccacgcttcccgcaccgatttttgaattctctcctatggtaaaggaaccgagtattttcgcaccggcacttaccatcacattgtccttcagggtagggtggcgcttgccggtctctttgcctgtgccgcccaaagtcactccctggtaaagagtcacattattgcctatgactgtagtctctccaatgataacaccggtaccatggtcaataaacagtccctttcctatttttgccccaggatggatttcaatacctgtttttctggctgccctctgggaaatccatctggcaaggaaataatggccgttttcatagagcctgtgagcccttctatattggatcatgacacggaagctgggatacagaaggacttccagcggcgtcttgatcgccgggtctctttcctggataacctgaaattcttctcttatatgtttgacaaatcccatggtctgtttcctttctataataaaaaacgtctctatatggctgttcctgccatatagagacgaagatatcactccgcggttccactctacttgaggacggtctgtcccccgctcatacctttaacgcaggtctgcggaccttcctgtcagacaggcaggtcagctcccggacgcactttcaccttttccttttcggacagctctcagccggtgactgtccttctctgtaaaaattcccaggctactctttccattcacagctttttccatatctgtctttagtttatgcataaatggcctgtttgtcaatggatttttcacctgctgatgcaaaaaccgtctttatccgactttttcacccggtacatggccgtatccgcagcccgataaagctgtgggaatgttgccccgtccctggggcttatggcaacgccaatgctggcggataccggttttcccacaccctccacctgaatgtttcttatctcctctaatatcatatcagctttctttttcgccagttctgaatccaccttaccctgcaggaacactgcaaattcatctccgcccatgcgcaccaccaggtcatccgagcggaaggttttgtttaaaacctcaccgacttttctcaggacaatatctcccacctcatgtccccatttatcattgatgcttttaaaatcatcaaggtcgatcataaaaagcacacctgccgtattttcttttaagctctgggatatcttccctaccgcggacttattataagtgttggttagcacgtccctctcgctgatctctaccaatctctgttctctttgcttgatatccgttatatcctgaagcttgcccaccaccacgctgtctttggcttttccgttaaagatagccttcagatggcaggaataccaataataccggccttcttttccctttaccctgagctgtatgcttctggtatccagagaatggggcatttcttttaaagtgttgtacaccatctccctgtcgtcaggatgtatgagtcccttatcgatcgtatgggaaaatttttcaaaacgaagagtatccagtcccagcatactcctggcgttgttggtgaactccaatacatcctgtccgcagaaatactcgaacagtacagtgtcggagaactgggcaagagccgcaaagcgcttctgttccagcacacgctctctctgctgtcttctgagcaccgcaaagcccgcacagaccgcagccatggtgagaattatgagaagcattcccgtaagaagtacgtttcggtagactgcgcgggagctgaccaacacatcctcctcgctgacaaaattgacaatgtaccagccattgtaatccattttttccacagacacataaaaatgcagcccgtccagcaaaatcttgtctgcaatttccgtatttttgctgttttccagcatatctctgacttttttttcatcttcggaggaaatccctctttcctccaggattccaaagagactgctgtccgtggtaaaatcaggaatcctggaataggcgatctcgccgtctcttgttgctatgaatgttctgactttcttatacattttgctttcctgcgtcacggaagtaaggatggtagccgggatttccgtctgcagtatcccggtgacccgcccgccctgtgacacgggaattcccaccgcaaagtaatatttccccttctcatccacacgaaaatggtcggatacggtggaacccttttgaaggagctgctgatagaccttctgttccgtaaaccagcattctcccttttccagttcctttctgatctcatccatatccagatattccagatggtatcccttattcttatctccgatacggttcagaaaaggggcaaaccattcctcttcggctgacaggccgttggtatccatcactgccgctatggcactcatcgtatttaaaatatccgatattttcccgttgagctgccttttctgattcttcgtgtaggcggagagattatttccgatcagcgtatcatactcctcattgagctttttctgctgtacggcaaaaattgaggagaccagaataataaatatgagacagcaggttccaagcactcccagcagttttccggtcttttcgggatgttccttcatagccatcagccctttacattttctcttgccatcagcagattggtaaatgcatctgcaggcataggtcttgcatagtaatagccctgtccgtattcgcaccccacagagcgcagaaagtctccctgctcttttgtctcgatcccttcagcaatggtatgcatgccgagttttttcgccatgcgcaccagggatgccaggatctcaggtcctcttcctgaaataccctggttctccaggaatttcatatccattttcaggatatccacaggtacatccttcagcatattcagagaagaatatccgctgccaaagtcatccatcagcacctggaatccataattctgcagctctttcatggcagccaaaagctgctgtggattgtccgtataggcactttccgtaatttccagccgcatcattcccggttccagccggtacctctctgtcaaatctataatgcttctgcagagattgggatcataaaattccagcctggaaacatttacggacacagggacacagttcaggctccggcgtcccagttccataatgttcctacagacttcctctctgatataggcgtccagtttaataatgaacccattatgttcaaaaaacgggataaagaatcccggtgacaccattcccttttccggatggttccacctcaccagggcctccgcactcaccacttcccctgttttcagatccacaacaggctgataataaacctcaaactgcctttggagaagtgcctcctccatggaattggtgagccgctgctcacttaagactacctgatgaagctcatcattgtacaccgcgtaagagcggtttgaatttccttttacagtgcgcagtgccagattggctctgtcgcacatcagatccacagacatgtctctgtcctctaccgtgtagacgccataatagagattgatcttctgttctatcttcacagacgcaaggctcttgtccatctgctcccgcacatactgcagctcctctgtgccggcgggcaggcatacagcaaaatggtccgcctccagtctgccgtaggttcctttatctttcaggcatttttggagaccctcggcgatgaggagcagtatcctgtcacccataaaattgccgtataactcattgatcaccttaaaacgctctatgtcaaactgcaccatattgtaggtgccatttggattctgtctcagaaaatccgctgtctttctacagaaggtagaacggttataaaggccggtaagagcatcgtgctccagcagatacctaagctcctcatttttctgttctatgagaagctcgttctccctgctctccgtcacgtcaatatttacaatgcggtacacaggcacgccatcctcctccttgtatttcagcgcattcagactgaaccacctgaggatctgatcctttcttctcacctgatggaccagagaaatcctgtcactgctgtcctgattttccctgagccgcttaagtatatattccgtatcgcctccaacccataaaacagtcagatccttggtaaacttttcctggaattcctccctgtcatagccgaactgacggcagaatccatcattaaaatattccacctgtaccttatctgtcaccttccagacaccgatgccgcccggaacagaatcaatcagggaattcaattcatttctcgtctcaaaaagagcattctccagcctttttcgctccagaatatgcttgaccactatgttttccacacgtttttttaccaccatggcccggtatggcttgttgataaaatcatccgccccaagtatgagggcacgctcctcagacttttctttctctgaggtagccataatcaccggaatgcctgaaaggctttcctcttctttcatggctttcaggacttcaaatccatccatgcgcggcatgacaatgtccaacaggacaacatccaccggctggctgcgcaggatttccatggcttccactccgtctgcagcctggagaatgctgtactcatcatcaaagatgttctccaggagtgctctgttcaattctacgtcatctgcaatcagcatggttttttctctctgcatctatttataacccttcctcgtttttctcctgtctgttcccatatactacggacgctctgcagaatttttctatcatgtcctgcatctttttcacgtccacgggctttgccagaaaaccgttcataccggccttttcagcggcctccacatcctcctgaaacgtattggcagtcatagccacgatgggcactgagagagaatcctcccgtcccatatgacgaattgcccgcgcagccttcagaccatccataaccggcatttttaagtccatcagtatcattccataggtctccggcctgctgtctgcaaaacactggacggcctgttttccatctgctgccaggtctgtccggattccccacattttcaaaatttctgctgttatctccgcattgatctcgttatcctctgccaaaaggactcttaaatcctcccatctgcactcacacccggaagtatcctctctgcagagcgttccccttctcaaaggcagcgtaaaggaaaacgcagcgcctttgcccggacagctttccacgctcagagtgccgcccataagttctgtcaggcttctgctgatggacaggcccaggccggttcccatctggcggctctctgtttcttctacctgttcaaaagctttaaagatcctctcctgatcctcccgggcaatcccgatccctgtatcttttaccagaaaccgtaccggcagaatccccttctcctccggctgcaccacagcttccagaagaatgctcccgccctcaggcgtaaacttcacggcatttgacagaagattcaaaaggatctgcttaatatgcatgctgtcaccttcaaaagcatcctcctcgttctccgcgcggagggtaaaatgaatatttttttcctttgtctgcaagagaaggatatccgtaatctccctcatcatcacgcccagggagaatggttcctctgttatcttcatcttgccgttttctatctttgacatatccaggatatcgttgatcagcgccagcagataaccggcagacactctgatctgttccagtctggtcctgcagctgtcaaagccctcctctgatctgaggcacagctccgtaaggccgatgactgcattcataggcgttcggatttcgtggctcatcctggagaggaaatcagattttgccctgtttgcccggtccgcggctctcagcgcttcttcgagcacctggcggctctcctcctccttcttcatcacatcatgcacgtctctggatgtcatcaggtacatatccctctgcccttcaaagcagcagatgcgcagctccttataccttcccttattggagagatagataaactgtaccagatccgtatctttctgaaggcactgttccagattttcaagacttatcttggagatccacgcatcccggtcctgctctgccacatagtacccggcaaactgttccagggttttgtcatacattcccgtaaggggaatatccgggtatgcctccttatcggaaaaccttatggcatactggttcttttttgcatctatgatactcagatactcataatcatgctccatggtaaaatcatagatagcctgaagacgaatattgtccagctccgcatttttttcttttgtgatgtcttccgtgattcctatgtaggaaatctggccttcccctgtcccatgctctaccgcagacaaaaaagatctgcaccagattcctgtcttccggcttctgaatacacaggcggcagtcttttccccctcatagatctgtcgaaacattttccgatagtcctgtgcaaactcttcctccacatgttcctcaatgaagctttccggcatatgagcatactcttttctgcatctgaaataccggcatgtgcgctcagaatttatcagtatcctcttctccggataataatagaaatcatagaaggctgtattctccagggaaaaccgcagaagctcccgactggcctccacctgccttttaaggttcacattccgcagttctgtctccttccgcttgtgaatgtcaataaacacactttgaaagaccagatccccgtctatatcatggagcagctccgcattgccaacgatccagcatttatccccattctttttgagcagtctgtattcataccctttccggtctccggcttttttgagggtagaaaattcctctatcacccgttccctgtcctcttctgccaccagtgccggcagattccagattttttttgcctgaaattcctccgggtcatatccgaaaatgcgcatggcctcattattggccatcataaattccacgctcatgtcatccttagccttatactggacgataccgcacagtacagactgcaagagcctgtcataccattccttctgcctttcgatctcctgtctgtgctccacctcatctgtgatgtcccggatggtgctgatacagatttcccttccggaatcagagacagcctttctgcccatatcattgacccagagataacttccgtccctgcgccgcatgcggtactgtacttcgtattcctctccttttgcaagggctgcttccacaacagcgtctatattcggagcatcctgggggtgcatacagttcatcactttgccgtctatatccctcacgtattcatcataagaggtatatcccaggtaattgagaagctggtcattgataaaatacaggggaaagccttcctctatatatccgcccatcatccctcccggtatacttcgcttgatcagatccatggaaaggccggaaatctgcttttccatctcttttctggactccctgccgttggaatccggaaaataagaaccctcttcctgatctgccgccgctaccgacgcatggatagagactatcttccatccctcttcttcccttatgcaaaaggctgtgacacgaagatatatggagatttcctcctccggctccctgcgtcctacctgcatccggatcagaacagaagcacactcacccaggtctctgctctctatgtattcataatttatataatagggcacggggtccatttccatctcttccctgagtgccctcatggcttccgtcttgtctcttgcaaattcctgttcaccggttcctatccactggatctcacggtgcagatagacctctgttttctccacactgcgttctaccagataggcataaaaaaatgcttttaccaaactttccgcgaaagggttcttcatgtatacctcccctgcatcttcctgcagttctgattatctttcattatagctcactgcgcgcctgcaaacaagatttttcaagacaaaagcgggcgcaaaatcttaagattctgcacccgctgcttacaagaggctgatttctatctattttatcttaattttcaaggaaggctgttcaaatcatacgttatcagcagatgccctgggcaagcattgcttctgcaactttttcaaatccggctgcattggcgccaactacatagttgccctcactgccgtattttttagctgcgtccaccatattgtggcagatgttgaccatgatactctgtaatttagcgtctacttcttcaaagctccagctaagacgttcactgttctgggacatctccagtgctgaagttgcaacgccgcctgcgttagcagctttacccggtgcaaagataacgccgttctcctgcagatactcggtagcttccagtgtggtaggcatattggcaccttcacataccgcaatgcatccattggctgctaactgttttgcgtcttcaagctgcagctcgttctgtgttgcacatggaagggcaatatccactttcacgctccatacacctttgccttcatgatactctgcatttggtctgtatttcttatactctgtcagacgggcgcgttttatttctttgatctcttttaaggctgccaggtcgattccttccggatcatagatccagcctgcagagtcagagcaggtcaccggcttagcgcctaactggtatgccttctcaatggcataaatggcaacatttcccgcaccggatactgcagcggtcttgccggcaagctctttgccgtttaacttcagcagttcctctgtcaggtataaaagtccatatcctgtagcctgtgttctcaccagagaaccgccatatgtcaggccttttcctgtgagaactccctcataagcgtcgcggatcctcttatactggccgaacataaatccgatctctcttgcgcctacaccgatatcaccggcaggtacgtcagtgtctgcaccgatgtgtctgtacagctctgtcatgaagctctggcagaatgccataacttctctgtctgattttcctttaggatcaaaatcagctccgccttttcctccgccgatcggaagaccggtaagggaatttttaaagatctgttcaaaacctaagaacttaatgattccaagatttacagacggatgaagcgaagacctcccttgtacggtccgatagcgctgttgaactgtacgcggtaacctttgttcacctgcacattacctttgtcgtctacccatggtacgcggaacatgataatgcgttccggctctaccagacgctccagcagtgcttctttgcggtatttttcctcatttgcttcaacaaccggtttcagggactccaggacctctctgacagcctgatgaaattccggttcacctggatttttcttaactactgattcaattacctcatctacgtatgacatgacgatcctcctatagtgatatgtgtaaaacttatgtaggttattataaaacctgttgccagattttgcaagttctatttttcattcttgcagattttttcataaattttacttttttgagattttttccaggaaaagtgaatctttattttgtgaaagtgtcatatacttctttggtttaaagtgttttatttgtagtgtattgacaatggccagtctctgtcagatcctggtcgtccattcagagcagtcccacaccttggaaaccaggccgtcatagaactccggttcgtggcataccatgaggatcgtacctttatattcctgcagggcacgctttaattccgccttggcatccacgtccagatggttggtgggctcatccaggagcagcaggttggtctgccggttcaggatcttgcagaggcggacctttgcctgctctccgccgctcaaaacacgcaccagactctcaatatgtttggtcgtcagtccgcattttgccagagctgccctcacttcatactgggtgtaggcaggaaactcctcccatatctcctcaatacaggtgcgtttgttgccctgaggcatttcctgttcaaaatacccgatctccagataatctcccagatgtactttgcccgacagcgcggggatcaatcctaaaatgctcttcagcagagtggtcttgccgatgccgttggcacctacaagggctatcttttcccctctctccaccgtaagggtcaggggctttgaaaggggttcctcatagcctatgaccagttcctttgtctccaccacaaagcggctgggggttctggctgtcagaaagtggaattccggctttggcttttccctggccagctcaatgacatccatcttgtccagcttcttctgtctggacatggccatattcctggtagccacacgggctttattgcgcgcgacaaagtccttcagctcactgatctcctgctgctgcctctggtatgccgcctcaagctgggatttctttactgcatagacttcctggaaatggtcatagtcccccacataccggttcaactgctggttatccatatgatagatcagattcaccacctggttcagaaatggtatgtcatgggagatcagtatgaaggcattttcataatcctgcagataccgcttcagccattctatatgcacctcatccagatagttggtgggctcatccaacagaaggatgtccggtttttccaggagcagccttcctaagagcaccttggtcctctggccgccgctcagatccgtcacatccttgtcaaggccgatatcggaaagtcccagtgctctgcccacttcctccactttagaatctataatgtagaaatcatgcatggtgagcatgtcctgaatggtgcccagttcctccatcatccgttccagctcctcctctgatgcctctcccatgcggtcgcagatggaattcatgttctcctccatctcaaaaagccaggcaaatgcggacttcagcacatcacggatggtcattccctttaccagtgcggtgtgctgatccagatatcccacacggacattttttgcccactcgatctttccctcatccggcatcagtttattggtgataatattcatgaaagtggattttccctcgccgttggcacccacaagaccgatatgctcgccctttaaaaggcggaaagatacatcctgaaaaatagccctgtcaccgaagccgtgggacaaatgttctacgtttaatatactcattgtttcctgatcctctcctgttgtttattactgtctctggcagcacccgccgcagcctccgcctgtgcggtcatccaccataagatccctggcatctgtaagcgcgcagacagcctgagcggaaatcccctcacctgtgccggtaaagccaagcccttcctctgtggttgctttgatattgacctggttttcctccaaatgcaggacctctgctacattttttaccatatgctcaatgtggggcatcattttgggtttctgcgcaataatggtggcgtcaatattgttgacgacatacatattttcttccagaagtgtgcccacatgcgcaagcagcttcatactggaaatccccttatattccggatctgtgtccgggaaatgtcttccgatatcgccaagcgctgctgcccccaaaagcgcatccataatggcatgcagaagcacatccgcgtcggaatgtcccagaaggcctttctcccaggggatattcactccccccagtatcagatcccttccctccaccagtttgtgtacatcataacccatacctacacgtatcatgataggtctcctttcctgccgtggttttatctattctgcggactgcccgccggattcatccgcggttctccgctttctcaatcttcattttcggccatacgcaaagtataacagataagccctccgcatgacaaggccgtcctatgcacatcaatccgaaactttaacaagcaaaactgtcattgacatctaaaaagcagaacaccacgttcaaatgatgttctgcccttttaacatttctttgtcagttgtacaaacttattgcattgttatttctgtcacttcatatccagcatccacaacagcctttttcagcgcatcttcagatacaccctcctctgcttccacatatgctgccttgtcatccaggcttacgtctgtctttttcacaccctccacggcattcagcgcttttgtcactgctgcctggcagtgggggcacatcattccttcaatcttcattgtgatcatttttatttcctccttattttccggcagtgttctgccttgttttacagtaccttcagtttctatctgttcctttgccgcaggcttcttcagtacgtgaaagaagcgaagccgcagggcattggtcacaacaaaaaagctgctgagactcatggctgccgcgccgaacatagggcttagctttaagccgaacatggggtacagaagccccgccgccaggggaattccacaggcgttatagaaaaatgcccagaacagattctgtttaatattgcggatgaccgctttgctcaggcctactgctgtgactacatccagaaggtcactcttcatcagcacgatatccgcactctcaatagccacatccgtacctgcaccaatggcgatccccacatcggctctggcaagagcaggcgcatcgttgatgccgtcgcctaccatagcgacagttcttccgccctcctgcaactttgccacttcccgctccttgtcctgaggcagcacctcagcaatgacggtatctatatccaactgccttttgatcgcctcggcagttcttctgttgtcacctgtgagcatgatgacttctatgcccagcttcttcatttcccgaatggcctgggcgcttgtatccttcaccacatcggctgcggctataatgcccaggatttccttctcatcaaagaacagaagcggggtcttaccctccatggccagacgctccatatcctgtctctgtttttctgcggcaatccctttttcctccgcaaacttctgacttcccgcaaagtacagttttccgtttattcgggcctgcacgccgcgtcccggcacagcaaggaaatcctctgctttgtcagctcttatcccctctacctttgccctctccagaattgcctctgccagaggatgttcacttttctcctccagggaagccgccactgtgagcagttctgtttccgtccgcttttccggaaggatatctgtcacctgcggttttccctgggtgatcgtacctgtcttatcaagcacaacactctttatattatgtgtgatctccagggcttcccctgacttgatgaggattccgttctccgcgccttttccggttcccaccatgatggctactggagttgcaagtcccagcgcacagggacaggagatgaccagcaccgcaatggcgcaggagagcgcaaattcaaaagccgctcccgctatgatccaggccactgccgtgatcagagcgatccccatgactaccggcacgaaaatacctgctatcttatctgcgatcttggcaatgggtgccttgctggaactggcttcctccaccaggcggatgatctgggaaaaggtggtgtcctccccaacttttgttccccggaaacggataaatcccgccttattcatggtagccgcgatcacggtatctcccactgtcttctccacaggaatgctctcccctgtgatggcggcctcatccacactggtgcttccctcgatgataataccgtctgcaggaatactgcttcccggttttacaacaaagatatcaccttccacagcctcctccgccggaatctctatctggcggccgtcccgctctaccacagcagttttaggtgccatatccatcagttttctgatggcctcgctggttttccccttggaacgtgcctccagatattttcccacattgataaatgccaatatcatcacagcagactcaaagtacagatcatgtctgtactggtccaccagtgctatatcctgtacaccaagtccataacctatgcggtaaatggcaaaaatgccgtaaacaagggaagccgcagaaccaatggcgatcagcgtatccatattgggtgctccgtgcatcagggtagaaaatccctttgtataatatgcccggttcacgatcaccaccggaaggcagagcaggaactgagtcatagcaaaccccaccccgttctccggtccgcttaaaaaccccggaagaggcagtcctgccatatgtcccatggacacatacatcagcggaatcaggaacagaaaagataggatcatccggttcttcatctcatgcatatgtttttccaccggggactctcccgcctttgccgcctctgtacgggaggtttgtgcttttggaacagctttaccggctcctgccttttcctgcccgcctgcggctgcagcgccgtagcctgcctgttccaccgcattttctatctcctgtacggacagtgcggactcatcgaaatccacctgcatgctgtttgtcagcagatttacgctgacatccttcgttccgggcagctttctgacacatttttctacccgggacgagcaggcggaacaggtcatgcctgtcacatcaaatttctgcttcataatatattactcccttctaagatcagacgcattttatttcaaaacatgggattggttcaagcggcagttcagccttccatcctcaccattacaatattttacccagcattgccacaagttcatccaccttttcttctctttcctcatccgtatccgcatttctgatacaattttttaaatgagctgtgagaatctccttatttgctttattcaaaatggcttccgttgccataagctgctgggaaatgtcaatacaataccggtcttcctccaccatcttcaaaatcccgtcaatctgtccccgtgctgtcttcaaaagacgattgatcttccctctgtctgcctgcatatacaagacccctttccaaaataaagatcataacggttccgtccccttatggctatgggcaaaaatccacgaggaaccgctttctatcactacacccctggggggtattatctttgttaaaaatacaataacaaaaaatggagtaaaagtcaacacttttactccattttcctgtcaccatttatttctcactttttccgcaaatcctagcatgcggcgaatctccagtttccttccgtcatccaagactgccgtgccgtcaaaaaagccgaacacctgatgctggtcactgagaatgatccccgcagaagtatacgctttgcgatccagtattggtacgaaggttaaatccagtctgtcatccgatgaggtaaaataccagggttccaaatacttctcacgcccttccttctccccgggaatatggaatctgacctgttcaagcttatgggcatgaccgtcatagaaaagcatgttttcagatgccgcggaggtatccccaaacccgtaacccaggttaaagccaaatacctttccatctatcagaccgtgcatggcactccaataccaggtatttttgtacgtccagacgccccgtccccaatccagaagaccgaagctgtcctcaggttcaaaataatggcgctgacctctgaattctaccactccttttgcacgcatgccgatgatcttctgattatagtaaaacgctttttccttctcaaaaggtgtggcgatcaccatgctgtccctgggttcttcatccagaatgattttcatccggatgggatcatggccctcaaaatctttcatccacgctctcaatacacgtctgccgttttcagcctgaaaggagaagtaacattttttatcccggtattttgtctctccatgcacggaatccggcggcagatttgtctttcccatagggaaaaccgtcatcgggcttactgtctgctctgtcttatgatcgaaatccagaaaagagatactcataagccccatatagctgttatcatccacagtcaatgccactccgaaatgaggattatagatgagataataatcccactccttaatcctgagaggattggcccggatctttcccctgtcatatctctttaccagtgacagggcatatcctgcctgtgccagatttcccctttcatccagcagttcccctggttccaactttttctgcatgtaaaatccccctttcacacagacaccatgttcttatcctagtgctacatctaaaatcatcatcaccacaaatccaacggcaaaaccaatggtcgcaatgttggaatgctctccctcactggcctccggtatcagctcttccaccaccacatacaccatggctcccgccgcaaaagacagcagatatggaaggaccggagtgatataggaagccagaaggattgtcagaaacgccccaataggctccacgatccccgaaagggttcccatgacaaaagcccgcatccttgtatttccctcacttttcagcggaagggagatgatagcaccctcagggaaattctggatggcaataccgatggaaagggcaaatgcgcccgtcatactgatatcggaattcttcgccagcatacctgcaaacaccacaccgacggccatgccctccggtatattatgaagcgttacagccaggaccagcatggtatttttcttcaggctgcacttttttccctccggttcgctgccgcctaaatgcagatggggaatcagacggtccatcagaagcaaaaagaacactccaagtccaaaacccactgcggccgggataaaggccagttttcccatgttctctgacatatccatggatgggatgagcagcgaccacacggaagcggctatcataacacctgacgcaaatcccaaaagcattttctgcaccaaaggcttgatctcatttttcaggaaaaacacacaggctgcccccagtgtagttcccgcaaagggaattaaaatccccagaaatgtattcatacttaatcacctgcttttctctgtttatttataaatctataactattcagtgccctcactgtcacgagcaaaattcctcgtaaactgaaaacaatgaactttttttatgaggttaaaaatattgtagcataacctgaagcaatttgcactaattttgttaagttttctattagttaaaagtaaccataaaatcgccccatatactgccaggtattttccgaggatcgcaggacaatactcgtggtgggtccggaatttcattttgatacaataaaaaaccctgcaaaacagacagccctacgactgtactcttttacagggtctatatataactgaattactgagatctctctgaattattgagccagtatttttcccagttttctgcaggcttctctttcctcttctccgggttcttcattgcagatcacactgccgcttaccagttctgcgccgtcttttctgcatgtatcctcccaggaacgcatccattcaccgtcaccccagccgtaagagccaaagagggcaattcttctgcccttcagtttcggctcacatttagcaaacaacggctggaattctgtttcctccagctcctcatctcccatggaagggcatccgaatgccactgcgtcaaactcatccatcttagccgggctgaatgtttccggggtaaaggaagatgcctccgcccccgcacttttggcgccttccaacacagcctcagccatcatctctgtatttcctgttccgctccaatataccaccgctattttactcatgataaaatcctccatatttataatgatcatcctctgtcagcggcttctcatgccgccactgccagtttccagacgggttttccctgctgccacaaccgaaggtaaatttccctgcatttccggaatttctcaaacagcttcatggtctcgcattcgttgcagtacactttccaacatcctgcacatttactgttttttcctgcgttttcaataaatccttttacatctcctaaaggatatcccagaaacaggcctatttcgtgagggaagttctcaccctcctcaagccgcatgcgcagtcgtctgatcgcctggtcagtgtcaatatccacatatccgtattcttttaaaaattctgccgtaccgggtcttgccagatcctctttcagtttctgccttctgtacacataaatcaatgccgtaccttcccgtcttctcactacggaaaaggatatcccctttgccgcaaactgctgcgtcagacttgtaagctgctcctccagttcttcccaggacttgtatggcatattaaaaagatttgctgtcttgatagatgccagtgtgggtgaacaatgttctatcagataacgttccagcatagttactcattcctttcctgcatactcttccaaaacattgtgcagggcagcagcactgcttgtgtgtaccctggctaccgggatctgattctttttcgcctcctgaagagcactcaccaccattttatgtgagacagtgttggtgaacaggatcatcaaatccgggcagcccagcttttttttcatggcacctttctctttggcgaaaaccttggccttacagccatgacatttacagatattttgatactgacagaccattctctcattcccgcctacaatgacaatactcatgggcaaattctcctttttgggttagttttaactaacttatgttttttattatagcggatgtatcaaggtacatccgcttattgggttatgtatgtgtgtgtggagtgataagttggttagctttagctaacttattacatactatacacagttttttggcttgtgtcaatatatttttcaaaaaatataagaagagaatgtctgaagttaccgttggcgggctgctatcccgggagacgttccccccaagaggatgctgtgaacagtaactgtcagaaaaatttatagctcaaaacactccaaatcttccggaacaaatagatttccgctgtagtacgctctgccctcctctgtataaaggcgttttctgtgggccagatttctgtcctctgtatgatacagtacaagattgggcacctccagctccccggctgtcacgcaggcatcctttaccgtgctgtgatgtttttcatagggtttaaatacatctctctgtgaatagagacaaaaggcctcgtgcatgagccagtcactgccttttataaatacttcatccttctcgttataaggctcgtctcccgcacaggtcagcctgactccctctttcgtcttcagggtaaatccgaactgtttcgcttttgttgaaaatatgtcaaaaaagaccgtctcacagcccagaatttccgcccgtcctccatgttccactgtgacgaagcggatgcgttcccccaggtgcctggtcactttcttctgaatggtcatttccgtgatggtggtgaggatttttttcaagtcctcgtggcagtaaatccgcagttctccattatactttccctgttctactgcagtgcctatcatgcgtatcatccagacaacaccgagaaggtgatccacatgttcatgtgtcacaaatatgtcatgtatatctgtgatggaaatatctgcctctttcagtcttctcagaattccgtttccccctcctgcatccaccagaaagtgctgtccgccttccgtcagggcaaaacaggtattgtaacattttgtcaccgtagcatggccggtgccaagcatagtaagtttcataaatggcctcccttttgttaaaaaccgtatatcataaactatcatagacatatttcggaaaaaaatcaatttctttctgtgttttatctcctatgttttatctcctgttccctatttcctgtcttttatgttgcgtgtcttgacattctgacctctattgtctatattagccgtaaatacagattgggggactactgcatgaagatcaaattacctgttacactttaccagcgtattctcggcatattgtcgtttttgttcctgatgggacaatttatatgtctcatacttcggtgggatcacatgcctgatgagattcccacccatttcggactgaatggccaggtggatgcttatggtaccagggggagcgtactgttactgcctgtcataagtattctgatctatctcctgatcctatttgtagaaaaattccctgaactctggaatgtacccggacacgtgacacctgagaatatgggatggatctatggaaatgtaaaaagtatgctggcctccacaaagttaggcgtctgttttatattcttttatatcaattactgtactgtatttagccgtaatctgggtgcctggttcatgcctgtctctctgctctatctttctggctccatggctttctttctctggagggcagtacactttaaatgatcctgcgcgctctgccgtgccacatataaaaacacgcgcacaaaaataaaaagcatgctataaagggcacataaacgcattttcatgcattcatgtgccctttttacttatctcagtgtgtcaacagcagctctctcaattgtaagtccttctttataccgtttgataaatttatcatatccggctgcatctgccgggtccggagcgatctcactgcctgtttcccctgcaaatactttatttgtcagataatcatccagcgtttcgttctcctctttgcggatcatataagatgccaacagggcaattccccaggctccgccttctcccgcggtttccataacagaaaccggcacattgatcgcccctgccataattttctgtcccacgccttttgtcttgaacaaaccgccatggcccaggatcttgtccagcttcacaccctcatcctttaacagaatgtcaagacctgtcttcaacgcgcccagggcagtgaacagatgcaccctcataaagttagccagattgaatctgctctccggcatacggacaaacagaggacgtccttcctcaaatccggtgatatgctccccggaaaaatagttatatgccagaagtcctccgcagtccgcatctccctcaagcgctttattgtacagggttccgaacagcttattcatatccacttccacaccgaacgcctctgcgaattccttaaacagagatacccaggcgttcagatcagaggtacagttgttgcagtgcaccatcgccacaaggttgcctgtgggagtggtcaccatatcgatctctttatatactttggaaagttccttctccagaacgaccatggcaaatacggaggttccggcagaaacattgcctgtgcgttttgcaatgctgttcgtggctgtcatgcctgtaccggcgtctccctccggcgggcataccggtatacctgcctgcaggtttccgctcacatccagtagttttgcgccttccgcagtcagtacacctgcatcttcgcctgcgcttaataccttcggcagaatgtctcccagcttccaggaataatttttctctgccaccagcgcatcgaactgctctatcatacgtgcatgatagtcccctgtgttcatgtcgatggggaacataccggaagcctcgccgactcccagaaccttttctcctgtcagtttccagtgaatgtatccggccagagttgtctggaatctgatctctgatacatgctcctctttgttcagaatagcctgatacagatgggcaatgctccatctctggggaatattgaaatcaaacacttctgtcagcttgtcagaagcctcctctgtcatggtatttctccaggtgcggaaaggtaccagcagttcatccttttcatcgaataccatgtagccgtgcatcatggcgctgaatcccacagctcccagttttgtaatgacaacgccgtatttttcctttacgtcctctgccatctttgcgtagctgtcctgaagccctgcccagacatcctccagggtataggtccagatattattttccagacggttttcccagtcatggctgccggatgcaatgggggcattatcttccccgatgagcactgctttaatgcgggtggaaccaaactcaatacccagcactgcgtttccgctttcaatcacattttttacattttccagatcaaatcccataaaatcatacctccgatatttttctcatttcgtaactgttcagtacccttacagttacctggctgttactcgattttcactatttctgtccgtaataggcatttgccccgtgttttctgtaatagtgcttgtcctgcaattcctggggtgccggctttacctgcggattgatcgtctcacaccgcgccgccatcttggcaacctcctccagaaccactgcattgtggactgcctcatggccgtctttgccccaggtaaacgggccgtggttcttgcacagcactgccggaaccgcttcatagtcattatttttgaaatattccgcaataagaaggcctgtattctgctcatatgccccgtcaatctcttcttttgtcaggcatctgacgcatgggatttctccatacatataatccgcgtgagtggtgccatagcaggggattccccttccggcctgtgcccagcttgtggcccatgaggaatgtgtatgtacgataccgccgatatttggaaatgctttataaagctcaatatgtgtaggtgtatcggaagatgggttgtattttccctcgatcttatttccttttagatccatgatgaccatatcatccggagtcagtttgtcatagtcaacaccacttggtttgatggcaaaatagcctgtctccttgtcgatctgacttacatttccccaggtaaaggttaccagtccatactttggcagcagcatattcgcttcgtacaccacttttttcaattcttccaacatcatttatctcctcgcttccgcttttatttttttcagtcttttcataacatcattgccgccccgcccgaaatgatcgtgcaggattttatattcccggtacagtctgtcataagctgccgcattttccggatttggcctgtaggtcctctcctctacacgtcccatggctttggccgcttcaaagatcgtatcatagccgcccttttcctttcctgccgccacagcgccgaacatggctgaaccaagggcaggggactggtcagaggcaccgataaaaatctcccggttggcaacatccgcgtaaatctgcatcatcatggcgttcttcttggaaatgccgccgcaggcgtaaagctcctccaccggtactcccgcctcctcaaaattatcaatgatggtgcgcatgccataggctgtggactcgaccaaagccctgtagatctcctccggctttgtggtcaatgtcagacccaggatcatacctgtcaaatctgcgtctaccagcacagagcggctgccgttccaccaatccagagcaataagcccgctctcccctattttcagacgggatgccttctctgtgagaagctcatggatattcatgtctctgctgtccgcctcctgataatatcccgcgggcacacagttctttacaaaccattcaaactggtcccccacacagggctgtcccgcctcatatccgtagagacccggaaggacaccatcctccactacgccgcagatgccgggaaccattttctcctgactgctgcacataataccgcaggtggaggtgcccatgatcatcagcagcttattcggctcagtgatccccacagccggcagggatacatgggcatccacattcgccacccccactgccatgccttctctaagacccagacgcttcgccatctcttttgtcagttcaccggctttcatcccctgggggcagacctcagctcccagcttctccttaaccacatgctccagacgcggatcgagagccttaaaaaatccggggtcagggtatccttccctcttattccagaaagccttgtatccggcagcgcagccgctgcgcttttcctgatcagtcagcttaaagatcacccagtctgcagcctccacaaaacggtcagcctgttcatagacttccggggtctctttcaagatctccataagttttggtatcatccactcagaggaaactttgcccccgtatcttgagagaaatgtctctccccgctcctctgccatgcgggtacagatatttgcctcctcctgtgccgcgtggtgcttccacagcttcagccatgcatggggaacatgttcccactcctcctgcagacagagaggcgtgccctctgcgtccaccggcatgacggtacaggctgtaaaatcaatagacaggccaataatatccccgggatccacactgctttccctcagaacagcaggtatggtgatatccagtacctccaggtagtccagaggatgttccagtgcccagtccgggggcagcctggttccgtccggcaggtattcctccatcactccgtgggtgtaaggttttgtgctctgggcgatcacggttccgtcagacacatccacaaggactgcccgtccggactgtgtgccgtaatccacgccgattgcgtattttctgttcatctgccttatttctcctatttgttctccgtatttctgcttttagtagacccgcgcacgatcagctccggctggatcagacgcggaatcctgcttttatcctccggtactttacggattttttccaaaagcagttcagcagccatttcacccagcttttcctggggatgtgcaatggttgtcagtcccacggtaccctctgcgatgacggaattgtcatatcccgtcacagaaatatcttccggcactctttttccgtttttctgaagggaacggatgacttccagtgcgatctggtcgttgtagcatacaacggcatccatctccacctgctgctgaagcagaagttctgtcatctgggcaggtttcatcttccggtcctctgtatggaaccataccaccatgtcaggatcataagaaagcccgctctcctggagcgctttcacatatcccttgtgccgttcctttccctgaaagtcatcggccttgaatatccccagtattttcctgtgtccgcagtccagcagatgttttgtgacaagatagccgcccttgcagtcgtccattaagatatggggtttgtccatcatctgcggatataccccctgaataaatacataggggatctcatactggtccagcattgcatacaagtttgtgtgcctgcagaaaatctggctcttgctcggttcaatgatcaggccttctatatcctttgtcagaatgtcctccagaacacgttcctctatggtacggctgttggctgtgtttttcaggatgatgctgtatccgttggctgtcatcaccttgtccatgccctgtatcaggcgcggaaaaatatagtcggatatgtaggttgtcacaactgcaatattccttgaattcttcatgtgccccatgcgttgggagcagaaggttccgcggccgtgctccgcttcgatatacccttcatttatgagaattgacagggccttgcgcaccgtatggcggctgatctgatagcgggcagacagttcattttccgagggcagcttctctccgggcttgatttctccgctcaaaatggactgctttagttcctccatgagcacataatattttgtctttccgttttcgtttgtcatatgcccctccttatagttgttattgtacaacttgtatggttctcttcacaagttgtttacaaacaaagaaatgattttttagacacactttggcgtaaatagaaaaagagcccggttttaccggacccctgcgatattttgttttttcaaaaattctcaaacatatgctccctgatctcacttatgatctggtccatctcctccagctcatctttttcaagctggataccgcactcctcgcagatatcccgaagagcagcaaatacccatggatttctggctttgatgcgcagcatcttcccgttatcctgcagatagttcacaaagaaatcaagcactacatctatctctgaatcctcaggattcaccatcttcatgtccagaaccatacccgacgcgtggtccagtgtcacaaacagaaggggactgatgggacgttcgtattcttctacttcaatactggcgtggacatatgcgaaatcgacggaaatctctgtccctaccttcggcctttttttcagacgtcttttcaggatctcatcctgcagtacaatgattggatattcccgctccaccataggaatggactctgcaaacatgttccacagccctgtcttttcattataggctctccacagtatttctcccttatcccagtccacaaaaatcctttcttctttcacagcacgcactgccatgaacaggttctgaaaggtttccgtgagtacctgcacttcccgtgcatccggtgtacagggcacgaatctgggcatacaggactgataaaaaggccatgccccacgtcctcggaatttaagttccagctcttttatcatttttttctgatcagggggaacttcttccctgtctccgaaataacaggtaagcgaacgctgttccagcattgcatagtcaggaggaagcccggtttcctctgtagaggcgatcatatcaaaatccctcagaccttccagcccttcgtagacactgaccccgtaacagtttccgccgcagcccataatgctcacgaaaacaggctcctcactgtcttgtaagaagatagctacaagctgggtgtcccagaaatatttccacggctccagagccttcagattgcaggttacctcatataatctctcccactgcttcggcgatgcctcatctctcatacacaaacctcctcctacgcttttatctgtctttccctgcagtaagcagctgcccgcttccctcttttcatcgggagatcagtcatgggacggtatgtactggcggatcctgccgcagaattctccgaaattctgtgtctgtaatatgatctttcccggtccggtaagcttagtgagaaatagcccctcaccacccagaaagatattcataccgccttttaccatctcgatctcgtactgtacactggactcaaagcccaccacatttccggtatccaccttgataacctctcccggcagaagttctttttctaccttattgccgtccacttccagaaataccatgccatttccctgcatctcctggagaatgaagccttccccaccgaaaaagccggaggacactttctttgtaaatgccacttttgtctccaccatgctctccgcgcagagaaaagaccccttctggcagtaaaatcctctgtactgccttaagtcaaccgggacgatttcacccggaaccgtggacgcaaacgcaaccatggctccatccatctccgcctgatagcttgtcataaaaaaggattctccggaaaacatacggcccaatccccgcataagaccgcctctcgcattggtgctcatgcttatgccctcactcatccagcacattccgcctgtctgcgtataaatactctctcctctgttcagcagcatttccactgccggcattacactgccctccagcttatatctcatgatccatgcgcctccttttctctcattactttttcaaccagttttggctgtatctcaggatatgtcaaagcctccggaagtctgtcgaaaagctctcttctctctatttcactttctatttctccaaaagaagtgatttccgcataataaagcatcccaaaagtctcctctccggtgtcattgaccctgtttttaccggtaactgagtagacagatacaggcttcagcgtaaaaatctttgcacccgtctcctcttttaattctcttgccgcagtctgctcaatactctcccccgcctccctgtggcctcccggaagctcataggtattgcgttttctgtgtttgaccaggaccattttctcccctgccattgccaggatcactgcaaatttcaaaagacggtcctcagcctgcccgtaaaattttacctctaacataaaatactcccccttttgcgacggaatatggttctttaagtcaaatacactctaatcctcgattttataccccatcacataatcatccatataaaatccattgcctatatcatttttttcttccctgagaatctgaaatcccatatgcctgtatatttcaacagcaggattatttttattcacattcagaaaaatctctcccagccccatctccgccgcttttttcctcacaaatcccaacatatgaccagcgtatcctctgcctcttttgctgtttttcagatagaatttactcagataaagcataccttcccggggataaaaagccctgctatataaccatcctgtacgcctataaacccctctacctgatgatgtgtctcatagacaagaatctctgctcttggaagctcctgcctgacatattcataatgctcttcccaataggacgagggtataaagctgtgagcctgacagttggcctgcagccagatttccattagtacttctatatcggcaggggtaaattttcttatcatacctgtcatttctattttcctttgtaactgtttcgcagccttttcttttacttatcagcctatcgacccgcccggcagttcctgcccagataacggaaaacttttcttctgtattccctgtattctatgccaaaaactttttccatatatttttcttcctgcagaatctgcagatgcagtgtaaatatagcaaagcaggtaaatgcaagcagcgggatattaaagaacataagtaagattccgatgtaagtcagatcaaacccgcaaaacgcagggtttctactgattgaatatataccttcagacaccatttttgtcctgtcactctccggaatgcctgcacgccaactgtcacgcatggtatacacagaaagtccaaaaatcatcaccccaactgtggcaatgatcagccctgcaatacgcatattctcagatgccttattgattccccataagatagataccaactcataaacaggtacgccgatggttgctattttcatgataaactctatgtacatgagttcctccgctttgtcccccttagcaatctggttcgtcctgattcctttctttttctgccccagcattttgccgaaatagatgccataaaacacaagcaataatacaatgctgcctgactgaaacttgtccatttgtggtatctcctctgttatgttattgtccgaatcccctttctattctgtcacagacacaggaagcttcctgctgcttttcactctgtggacagcagtgaattctttcaatacagtataccctacatgcctcaggattgcaattgttaaaatcctgtggtatatcccgggattttacattgctgcgttatctgtaatttactactaatttaccatttacgaaagagctttgatatgacgctgtgattaagagtttgtaaatgcaaaaaaccgcagattatatgtggttcactcattagtgacacataacctacggtttttctacgttaaacttatagcagacacaaatgtcctacagatttccccatacggcatttttctattttccaaacaagtcgctgtgtgtgcctgtgcgagccaacgttaagacaagaacatcattttccacccgatatacaagtaaccaatcaggtaagatgtgacactcacgatgtccgttccagttgccaccaagagcatggtctttgtttttctccggcagcgggacaccgttcgctagactgatgatgatttcctctaatagctcaattttcaatccacgtttgattgctaacttgtaatctttcttgaattgtgtggtaggtttaacagtatattttgtcattctttcaaatctgcgaaaagctgattgagatcagtatagcccttaacagcagggtctttcgcaatcctttccgcttcaagcattgcagtaacggtctccttatttggcttatttagcgaaacatcaaaaggaataccgccctcacgaagcgcttgccgaacaaaaatattaaacgccgtggaaatattcataccgagctctgcaaaaagctcatccgcttgagattttagttccgcatccatgcgaatgctgatgttggttgtattgccagtcatgttatcaactcccttctaactatacttatagtatatgccatttgcacaaaaaacgcaatacaatgcacgaaatagtttgaaattgttttctgacatagttaaaaccataaacgataacatataaggtaagcgtgagttgtggtttaatatccttaactgtggaaaattccacgttcccatttcgctactgccttatcgctgacgtgcagttttgccgccaaatctttttgtgtcatttgattcgattttcgcaactttaatattaactgcctcgttttttcattttccatacataagctcctccgtatatttatatgttcattctactatcaaaaagcattcacacaagaaacacgccatagaattgcacaaaacgaagtataccaacagtagaacttagcaaatgttcactcaataggtatgcggtctgctgaaaactaattatttatgttattttaaaatcaaagaggctcatctggctggccgcatttttctcctcgaacttatgcaggtaagaaaagatcttgtccatattgctttccagaccattttccctgcaaatctgataaaaaacggacatgagtctctttccgttgggactgcccacttcataggcatttccataagtttcgatatattttctgcgaagcccgggaaaatgctgttccagtttttcgtaaaaatactgtctgtcaccgtcccgcagggtgactcccatgccaaagttcaatacaccgtatgtttttgccctgactgcatagtccataacgccccttatattttcctccgtatcatttataaaaggcagaacaggacacagccatactactgtgggaattccttcttcccggaggatatttaatacctctgcacgccgttttgtggtacacacattcggctccaggatacggcacaagtcctcatccgctgtagtcagggtcatctgcaccacgcactttgtcttttcattgatcctcttcagcagatccagatcccgcaggactaaatcggattttgtctgcaccgctgcgccgaaaccataatgttcaataagctccagacattttctggtcaggcagagcttcttctccaggggcagataggggtcactcatagctcctgttcctatcatgcactttttcctcttgcttctgagtgctgattccagaagctgcggagcatttatctttacttctatatcctcaaaatcatgtttcattccatagcaggtgctcctggaatcacagtatatacagccatggctgcagccacggtacaggttcataccgtttttggaggataaaatagattttgcttctgctttgtgcataccgctgtctgcctcctatgataaactgccattcaatctctcttccaaaatttctgttcctgtatggaaagtgctgttgacttcccggtaaagattttcatagaaatcaactgccgcggctttccgttccatagcgatttcacggcctctcttggtgtgcatcatatcataaatcttaatgagcttatgtttatattcatggtaataggaatccgcggtctcttcttccccattcgctatctgtccgtcaggcagacgtgtatatatgggttcggactcctgtcccccatactgaagtgtccgggcagccccgacagcgccggtcacatcaattttgtctgcgtcgaacaatattttcgcctctgtactttccggctgtgttcctttccctttcctgaacctgtgtgcccggatgcaatgttctactttggcgatataatcccggtcacagccccgttctgccaaaaatcttccggccatctccgcgcctgccacagcgtggcatatctttttcccctctgcctgcgctttcctgccgatatcgtgcagaagacaggcacagatcagaacatcatgatcaacatctttctcgtattctgcaatgtccagagccgtataaagaacacggtaaatatgttccacatcgtgtgcgctgtcctgcatacaggatttcatatacgcctctatctgttcatatgtctttttatctattttggtttccactcctttctgatctatgtaggatcatacgtatttttctgagcagatggtaccttcgcattacatgtcaacagcaattctgttcacatgctccacaaaagcctctaccctctccatatcaggattgtccggcagacagctctcgttggaagccttctccattctcaactcatagtctgccaggatatcataaaattcactggagaatgttttatcctctttctgaaatcctccgttacgtattttcaggagcagatccagatctttcttccggtttgtccgtatttcccctttttccaggatatcaatggccatcataaataaccggatcaaatgcatggcatgtttgttcagatggtcatcatcctttttccggttgcgttttcccactttatcatagtctttgaccacattatgcatagctgaccacatattctcatagtcacgcagaggcaggtgctgataatccgcatccacaaaaatttccgtttccagatccgggttctccgatttgtctacatataaatgtatcctgcccttgtcaaaactgctgtaacgccgttcaaaatcatccagcgcgtttctgacggaattcagaatatgcttctccttttccgtctggggaagtgcatccctggcagcggcattctggagtcttctcagctgcgctcctgcgtagccgccaaaagatttgactgcccgctttgataaaaacagccccctattgtccagaagctcctgcccaagctttgtcctgatcagatactgttcctcgtccaggcctaaaatctcacaggtattcggattacagtccagtagcaatttgactatcttattaaaagcgtagatcacggtatctgttttcttgtcctcatactgttcaaacacggtcagtcccaaaaggtcagaaggcaggttcagggtaattcccctgaaatccacatcactgttctcattatttgtcccgtaagcgtagctcccgcccaaacccaaaagaatgatcctgtcccccagcctcttgtcttccctcagaaaatcataagcttctgtgcgcatcaactgcctgaaatctatcatttcctgctgcccgcctttcctatcgatcaagaacagtatacacgcccaaacatgacaaccgtgtgtcatattttttccaactgtcctcatttaccgttctcctgccgcatatgttacattgcaaacatatttccttttaactctacccccgccaattctgccagccgtatgatcccctcctcagccagcgtcactgtggactccacatgaataaaatccgtcacgctatagtcaaagaggatatttccctgtgccgggaattcctcatcttggtcccagaacagatactgcatgggaatacaggaaaatgcattcagaatatatcccgcatctccctgccggaccggcctgccgcccattttttcggcggcatacttcagttcccgggtcttctctgcaaaggtcatggcaaaaggtttcaatatatttctttcaaaggccggcgcaaaaggtccggcattttttacatctctgaaaggcacccagcgatctgcaaaactcacattctccttggaataccagaacaggttgtaaatattcatcctggtcccgttactgacggggcggctgtcctccatggcttttatatatccatcttttctgtggatgccatattttcttccaaaatgtaaaacagtcaggtactcaccctccgcttttatttccggcagtttcctcatcagtgcttcctggtccatctgtaaaaatttttctctccaggtttcactgagcttatcgtaatttgattgttgcggcttctgcatctttcctctcccttctgtccccttaatatgaacggatgccttctctgtcctattaccaaatatatgtatactacagttgttttctattgctttattataccggattcccttagtgattacaatcaaataccggcattggaatactgccggcccgaatgtataacgtttttttcatccttaaaaaagaaaagcgcataccataatggcaacgccccataaggaagtttttatgtaaggtacggtgtaacctcagaaatggggttgcaccgtttccttttgcccttatgctacaaagcggaagtcctgcgaattttcccgtatttcttccatcatagcaaggatttcctgttcggtaggaatgccttaattttatttacttcttcatccgaaagaaacaagtgcgttgcccgaacagaattttcccaaacagtcaagagtacttccagcaactgctgatttctgtcctgtacctcgtatattctcatattatcgtatcctcacaactttagatttatcttctcatcttttatttggaatacccagagagtttatccacggcacgagaaacacttggttgaaagaaaatatctttacctctattgctctcgtacataaaatctcttaatggcttgcttgtatattgtgagaaatcgccgtatatagcaaatttcactccataatttataaacttttgaagtatctctcctgccatacaggtactcaaaatgaagaaatcatctacaatcgcttctttgtttaccgcaatatttttacatcccgtttcatattttacactcataatcagatccaacgctgactgaacatccgtgattaagtgttcatcgctatgaataacagcaacagacacattattcttttttacaacttctgttttcatttttacctccataaattctatattgtttttattactgacttcgtttgccaacgattgcttttatatcgcaaagcaacaattacacttgatacacaccatccgcagcaagaagctattgcaatcgcaagaagccctaatttccctataaaaagaatagtaacgagcatttttaccataatggaagcaagtgagtaaatccccgcaatcagcgtatcgcctgctcctgacaggacaccgcctaaaccgtatattatggcattaactggataaaaccacaaacaaactttgaagtaactataaccacttaaaatcattgctttgttattaccaataatcaatcccaatatttgcttcccgcccagtaataatgcgacagacagcgttattgtgaccgcaatagaaagaactacaccgaatctcgttcctcgcttcattcgctccttttcattcgcaccaatgttttgccccgcaaaaatactcaaagaatttccgagagcttgaacaggtaatagttactcatataaatcgtcaatcaatttgtcagtcataaaatcaaagacttccaaatgattttgcggtaaaatatctttattcttgatattcataatcagcgaatagataactgaaatagccatattgtcattgactctaaatttcaaagtggggtgacaaagaaatagttgtctgcttagttcgcctgcttgttccatttcttttgcctgttcctctgatactttgttcattagaattgtatagtcggcggtatccgagccatacaaaaaagaattcttatcataagctcgatagataagtttcaaggcttttaccacacctgattttcctttttcttcttccattgccgcctcagccatttcacaaatttcacgctgtacagaacacaatacctcacaaaaaagagcttctttcgactcaaaaaaaagataaaatgctcctttggatatgccaacctgtttacacatttcatcaacacttgtttttttatatccatactgtgtccagctctgcttacaaatgtcaatcaaactttttctaatattttctttttccctttcagaaaagctccttgccataattcaatctcccttctatgactcaaaataccatttcagtcatagatataataacacttaaattttcaaaagtcaagtaggataaaaaatctgcttttatatataaaaacagacagaggttttacaccctgtctgttatccatttatgcatagattatctcgctattcacaatttccatagcacacgcccgtgtgttattcattcgtccaacccattctaaagggttttccgcttttaactgctctgtgataccctgtgcctgtttcatctgctctgtgagcgtttcaaagcgttcctgtgcctgcctgtcaatgtcggcaaggtaagtgttcagtttgccgcttgtgagcagattggtgtatgtaagcctgtgatattcctttaagtaccgcaaatgccgctgtccgaataagcctaacgactgttctttttcggcgggtaaggtgaggcagggtataaagtaatcgtcccgcatttcgtatgtaccgcccatttcttcaaaaattgattttgccattgtgttgtcctccataaatgattttgaatttctttttcttggcgtttgcaaattttatgagcaattcatttactgcgtctgtgtatctgccttccgaaagcaagcggttacgcaattcatttagacttcgtataataacacctccctcaagctcatcaaaaactaaataataattctgctctcgcatagcttcgacctccttgtttacatttgtaaacaaacggggaaataattacgaatgtgcgatttgattttttatacagaaaaagacaccgagaaaagtatttctacctttctcagtgtctttcgcctttgcaacgcccgtaatggttagtattctgatgtgttttcaaattacttccttatcgggcgttagcaaaaggtatacactttttcttagttaatccaattctatctctatgagttctgccgccggaagttttttggtagaggaagccttatacttcttcaactccgctgccgcctcctttaacggaatgttggttcccgctcccgccatacatccgccgggacagcccatgccttctatgagacatcctttcattttgcctgccttggctagggtgagcacttttttacactctgccaggccttctgcatgttcaatatgtaccgggacatccgggtggtattcctgcagacattcctcaatggcctgtgccacgcctcctgctaccgcatagcctcttccggctgcggtggcattgtgcaggcttccatcttcctccatcaaagccgggtctatctcttttgcgtcaaacatgccctgcagttcctcaaaggtaatgacaaaatccacatcgctgcggacatcggttctggatgcctccagtttttttgccgcacagggacctatgaagaccacacctgcattggggtatttctgcttaatgcttctcgcagaagccaccataggagtcagttcctgggacacactttctatcagatccgggaactgcttcttagccagcatagaccatgaagggcagcaggatgtaagcagaaacggaagttctccggtgctcaccttttccgcatagtgatgggcttccgcaattgcccctatgtcggctccgagcgctacctcgtatacttcctgaaaacccagttttatcagtgctgctttgaactttgccggggttacatcctttccgaactgccctacaaatgccggcgctacttctgcaatgatcttttttccctcgcgcagcgctctggagagctggaagatctgggatttatccgatattgccccaaaaggacagctcaccatacacatgccgcaggatacacatttctccgggtcaatggctgctctgcccagattgtcgctgccgatggctttgacaccgcaggccctggcacagggacgttccattttggagatggcatcataagggcagattgctttgcatttaccgcatttgatacatttttcctgatcgatcacagactttccattcactatggaaatggcatccttgggacagacctgtttacatggatgagccacacagcctctgcacatattgctgacctggtatttgttcggctcacaggcatcacaggcagaggggatgacctgcataaggggaggctcataatacttttcatctatgttgctgttttccattccggcagtgatgtgaacggcttcattttccggccgcagggacatacccatggcaaggcggacacgttcgctggcaaccgctctttccctgtaaatgctctccctgtaggaggcccgctctttcacaatgtgatacggaatggcttctatctcgtcattgaaattatcctttgtggattcaaaagctaccttgcagatttctgtaaatacttcacgcctgattttctttaccggggtttccacacttctcattttaaaatctcctgttctcaatcgcgctctaataccatctatccgcactaaaatggttagaatctatagtttcatacatcttccattctatggattgtcagaagaaatgcaagttttttattccatacacgacatatctgctacatctcattcctatcttttttcatcatcttataagacagacatatgggtttacccgtccacgggtcccggctgatacaggcatccaaggaaaatacatccgccagagtttcttttgtcatgatctcttttggggttccctcatacagcattctgccggagcgcatggctatcatccagtccgaaaatctggctgccagattcagatcatgaaggaccatggctatggttttcttctgttttttattcaattcctccaaaagctccagcacttcaagctggtgagccatatccagatacgtggtcggctcatctaaaaggatcaggggcgtatcctgggcaagagccatagctatccaggctctctgcctctgccctccggaaagagcatctatatccctgtctgccaattcctccatatcggtgatggacaacgcccacttcactgcttcctggtcttccttcttcagacgtccgaatcccttttgatgaggatatctgccgtaagccaccagttcctttacggtcaatccccccggtgcctgaggcccttgtggaagaatcgccattttctttgccacctccacagtggacatcttggcaatctgtctgccgtccagcagtacatggccttcccgaatgggtgtcatacgggacagggcttttaaaagggtggattttccgcatccgttaggaccgatgacagaagtaatacgtcctcttggaatctgcacatccatggcggggatgacaatgttttgatggtatgcaacggaaactccttttcctgaaagtacagcatccatattaaaattctcctttacgttttgatcagcagatacagaaaatacggggcaccgatcacggccgccacgattccaacaggaatctcatttggtgacaacagtgtacgtgagatcatatcggaatatgtcatcagcacggcccccgtaagcactgcagccggaaccagtatcctgaaattcggccccaccaggcggcgtgccatatgtgggcagacaagtcctacaaagctcagtccgccgcccactgcacagcagagaccggacatggcaacggccgctcccagaaggatcaccgtctgtcgtggcacgtctgctcccagtcctgccgcagtctgatcactgagggacagcacattcagggtacggcttttgtaaaagacaaacagcccaagaataagaaggcagtaaaaaagcagccgcacattcttccagtcagcaccccagatgctgcctgacagccatttctgcacaaatgcgtgattgctgtcaggcaggcgcagcattaatatggtagtcacacttgacacagcagtggaaaccgccacgcccatcaaaagcagcctgccaggagaaatcccctgtcttgtaagcgccagtctgtaatccagcgctgccactgctatcgaaccggcaaaggccagaagaggaagcagcacggtcaaactgactggactttgcggtacaaataccagaaatcccgccacaaaaagtccggctcctgcattgattcccaggattccgggttcagccatatggtttccggatactccctggatcacacagccggagactgccaggcccacacccaccagaagactggtaaaaactctgggaagcctcaggttaataagtgtataacgtacaccttctgcacctttgccccgcaggatttcccaaatttcctccggacttatcttccggtaacccgcgtttatctccagccatattccccaaagcagcagcagggtcaaaaggataaataccgtacctgtacggatcctgcgtcttctctcactcaaaagtcctctcctccttccgggctgtccagataaaaaacggcacaccgatcacagcaaataccaggcccacaggcacttctcccggcgcgttgataactcttgagagaatgtctgccgccagcataaagaaagcccccgctgccatggagcaggggataactgacctgtaatccgcaccggtaaaataccgcacaacgtgaggcaccatcagccccacaaaagccaccggaccggcaagcgccacagagccgccggcaagcagcagcacggtcaaaagacagactgcgcgggagcgttccacagaaaggccaagacctctcgcagcgtcctcccccagactcagaagagaaaccctgccggaaagcgcggctgcccctgcaagccccaaaaggatcactggtcctgcaaatataagctgctctcttcgtatccccgccacacctcctgcagtccaaaaggtaagatcatatccgattttatacaaaatcgccactgcctgactcagagaggtgagaaatatactcacagcacttcccgcaagcacaagccgtaccgggtccagtctgcgtctgttcaggctcataagaccatataccaccagcatagctgccgctgcccccaaaaacgaaaaaactaccacgccggaaaaactcagccccggaagaaaggccaggcagagcgccagcgcaaaagaagcgcctgcattgatgcccagaagcccggaatctgccagagggtttcttgtcactccctgcatcatggcacctgctgttgaaaacgctgcgcctaccagaatacaccccgctgtccgcggcagcctcagctcccgaatgaccagatgctgctggtctgtaagatccgggtttatcaatgcattcataacctgccggggaggaataccggtgcttccatataatatggaaaggactgcggcagtcaaaaccgccgcagctcctgctgtcaaaaaccatactgttctcttttttgcatttaggcccattattttccctcaaatcctcggaagaaatcaataaagatatcaagctgcgcattataggtgatggggtccctgtgcataaaggacacctgctcataaggaagtatccgccctttttgtacagcttccagactgttccagagccgggaatcatccacataggatccgtccgtatcagccagaacgccatacaggataaaatcccctgtatattccggcagggcttccagagataccacctgatactgggtatcgccgtccaccatttctctctgtactgcctcaggtgctttcagttcccacatatcgtagagaatggagccaccccttgcaaagtgactgcccatggtgtaaatctgctgaggccatacctccacaatagatacggtcctgtcacctacaatcccttgtatctcatcttttacactcagcgcacgctctttaaaatcagcaatgtactcctccgcttccccgctttttcctaccagatcggcaatatagcggaagacttcctcatcacttctctttccgtcctgaatataaacagtgggagcaatttcagaatatttctcataatccgcctctgtaatcgtcacgatcagatccggctccttggccactatcatttccagagaagtctccgcactggtaatgtccatttctttaatgccatccgttttatctgaaagaaacggattagacagagaataaggagaggctatggccggttttacatccacagccaaaaattcacccagataatagtcagaaacaatggtctgtggattttcaggaatttcaacctgacctttatctgtctggactgtgcgcattccctccttcactgcggaagaggaaatattcttatcaggactttctgcaccctgaaccgtactctcgttacctgtacccacctttcctttttctgcatctgccctctgtcccgaacagcctgtcagcaggcccgcagcagtcagtacagcaaaaaacggtaccagtttattcctcatattcatcataatgtctgccctttctccataccataattttctttagttagttatagctaattgacagcagtcattctagcatactatactatttaaggcaacatttttttataattgcacctaaatagaatatatctgtcaccgtattaaaaaacatgatttatgtggtaaatcacagaagctgaggaataataagattacatctggataataagaatgccgatgcaggatgatccgaactactgtctgcgagacggttatggctgctgataagtcgtttcatcatcggaaaaggagtataaaaatgagtatacacagtcaccgtgaccttcaaaataatattctgcaaaacctgggatttcatttggtcaaaggtaatcactgcacccgttttgccaacaaaagccgcccagaggacggaatctttgttttatatgaacggcccggtctttactcacttgccgcggcagactatacggctgcaacctccttttctcttgcctttgaatcagaggagaccgtgctccggttcggcagtttctacgacggcaaaacccattttgaaattgaagggattacgtcacactcctcctccccttcatcctttctggtacgggaggagaagataaagggccggcagttctggaatgcaggacagcactgcaggggaattgaatttgccttattccctgctttcttaaaacaattaaaaacaatcgacccgcatgcttctgtactggacagtctctccaaaaaccgcacttaccattcattacccccggcaatcatcaccatatttcaccaattattaccaataatacaaacagacagcctcaccccgcttatgctggaaggctgtctgctgcagtgcatgggaatactgaccgagtccatcaggcagggggcactgcgtgcaccggatgtaatgcccagcgtatttttaggcaggaaaaaaatcacctttgacgagtttgatctgtcggcagttcagcaggctaaacagatactgacagaaaatccggccaatgctccaaccatctcacaactcagtaaacaggtttgtctaaatgaacagaagctgaaagcaggtttttccatgtgctttcacatgaccattggccgctacctgaaagaatgccgtatggctaaggctgccgacctgctcacctccacctccctgagtgtccgggagatcgggttagctgtggggtatacaagcagtgctgcctttatcaaaaccttccggcagcactataaaatgacgcctcaaaagttccgctgcgcggataccccaaaatagtcctctgccaatatggcataccctgatgcatcgcatatcccctggttattcctatccgcctgtcttctggtaccttcgtaaaccataccgcattttttcattacttttccagaattgacatttcgtgggtcatggcgggtttctacacgatttaccttcacttcctccatgaaaaaacggatgacctctttaagcgcctccgaagtcacaccctgatgccaccatctctttccaatacagtaaccgatgtgaaccatctctatggagtcatctttggaaacaactgaaatagagcctataggctcctccccgttttcctttacagtgatcgcccactgatagaaatccttctcaccatagtggaaaatccagtcttccaaaacttctcgggacacctccgggcttttgtgggacggccacataaggtattttgttacctggtcatcatttgcccaattgcggaacatagctgctgcatcccgtatggtaaaacgccgcaggatcaatctttctgtctggagtttctctgttcctttgtgctgcatattttcattccccttcctttatcagtattctaaaatagttcatccagcaagatataatacctgatcttatcccagtctggaacaattcccaactcctcaaaaagctgttttttatactttcctgaagctttctttccataactgcctctcattctattgtggtcagagctgctttttcataaagatcaaatctttctctgtctcaaaaccgttcttttcataaaaatgctctgtggcattcccgcgcagggtcataagcataatttctttaatgtttctctcacgcagtcttttctcaaattcccggtagatagccgaaccgatgccatttccccggctggcatttttcacacaaaattcttttatttcaaataataccccgtcataaaactgttcggcaaatccgaatatcataccgcagagcatttccccctcaaacgcacagataccgtaaaatgtctttgcctctgccatctgcctaagcctgatctctgcggtctcctgggaccacgcatcattccagggcggggcattaaaggtttccacatacatggccgcaagagctgccaaatcatctttttcaatttctttatatgtaaacatcaaactgtcctcctctttatatttgttttattctgtccgcaaaaaatgtttctgctgttttatctgctgatttcatcttctgaatctgtttagatgcagtatagcatgacggatggaaggcatcaacagaatcatcagtcaaactgcgtcttccagtgctccgctctggctgcttcaaaacacatagcaatctgttcccttgtatttttatcttctgccaacaggggaagttcatccatggaaaaataaccgctgtccacagtttccagatttttctcaaaatgtccgcctattactgtacacaacacaatcactttacagattttataggcgtaccggggctgattgtgtttttccctgtcttgtatggcaataaccatatcagccgtcacatcaaggcctgcctcctccttcacctctttgatggtattctccttcacagacagatccacatccacccatccgccgggcatggaccatctgccgtcattttctttcaccaaaaggatcttgtccccctcaatgatcgctgccctgcagtccattttcggtgtctgataccccacctcacagcagaacaaatcctttgctttctcaaaaggcatttctgcctgctggctgatgatctccgcagagatttcacggatacgttcaaaacgttctatatcgtacttatctttgcagtaatacagggcactctgggccagactctgcagttccactgcccagtctaaccagttttgtttttcgtctttcatatgtactaattgcaggtttttcccactgatgctatacggtgagaagccacggctttttccggcctgctgctcctttctttattctgttattcttgtaactgcttaatcccttcactgttaccaacaaaaatccatgctatgcctgtaccgtgccttccccaaagccgttttgataagtctcatcttccattaaccccatctactgaacacacaaaacagcactacaatcggcaggacagcggtacctggtcctttgttttgattatacaagattctttatctattgacaacggaacctctgcatttcctgcagacatatcacaaaagcctgcgtacatatttacagttctccaccgtctgtgatagacttgtgtccgtaacgcaacgtgtgtaagctgatttagaagtttcccctttattatgggcataaaaatgcccctttgaggtaaggaatgccgcattttgattcataccccaaaagagctgtttttatttatgatacaaagtaatttatattgtcaatgtagactaataaatcttataaattattacaatttatatttatccttaaactttttccttctcaaaaatatcactccaaaaattataaatacaataactgcagaggctgttatcacatactgtgcaatcggctgtgacttttttccaatatctattactgctgatccacccccttgcccaaatgtatccggaacattggccgccgcttgcattacgcttttaaaatcgtatgcttgaaagccatctggatctgaaggctccagttcttcatctgaatatatattactacgcgttttactgctgtcagttatcattgcagcagcagatgtccgtgctggaatcacatacaaaattctctcgttatcaagtgccatgaataaaggctgtctaataggagctacaccaccgaccaaaaaaaattgatatgcattgattccaatttcgtttttttccagagatgcgtttaactgttcttctagtgttaaatttccgggttcgtaaacatacaccccttccactccccatgggccagtctgctgcccattttcatctcgttctcttgtaacacaagcttcatacaaaacttcatcagcacgaatagaaactatccacatatacggacttctgtttaaagcatccattacttctgcataatcaataagcttattttcaattagaggtgtatccaagtattccttaaccgcattatcaaggtcaacatcctcaattgttatttgtcgtcctcctgatgatgtcgttggaccattatttacagattgaacaatttgactttcaatattatatattgaatcataatcctcggagtcctttaatttttctatagaatctgccatgacatcttgagctataaaaaagattgaaatcagcactcccagtataataaccctgctcttctttttcattattgtcccttctccttcgccgtgttttatttaaatcacgtgctactaaataatgcctattaagtcgtgttgacgtattcttccaattggcatagatttcatacagattatttttatcattcgtttatttgtaagtgctcttaagcttctgttacggcaaagaagaccggaaataaaattgctgcatagaagtgacccgtgaaaaactggatacgatcctgtaacctattatcaaagagttgagatttagtctcgtcagaactcctttgttttgattatacaagattctttatctattgacaacggaacctctgcatttcctacagacatatcacaaaagcctgcgtactcatttacagttctccaccgtctgtgatagacttgttttatatcaggcagagaaattcctgcgaaatactttcgtttctcttgaccttcccctgcaggggacggtttaaactagaataagaggaggttatatgtataaaatcagtcaattttccaaaatttccgatctaactgtgaaagcactgcgttattacgataaagaagggattctgtcaccatccttccgggatgaggagaatcaataccggtattataatgatgcggattttgaaaaagcccggctcatcaaatatcttcgttctctggacttctcaataatggaaatccgggaaattctggaaactgcagagactgagaatgatttggcatttatactaagagagaaaataaaaataattgaaaagaatatttcaaaggaaaaagaactcatacgaaaaatcagcaaaggactccctgcatatgaaacaaaacagcctgctctgccatacaagattgacgttacagacgtaaaagaaatgcttgcagccacaattcgctttacaggcagatatagtgaccttggaaagtatgtgccgcttctctatcaggcagtgaaggactgcaagacaggcagacattttaactgttattatgatgacgcctgtgtggaacaggcagatattgaactctgcctgcccgtcaaatgcagaataacccatccatctgtgacttgcaaaaaactgcccggcattaaagcactgcgtaccctccattatggcagctacgatactttatatcttgcgtataaatctgtctttgcctatgccaatgccaacaactataaaattttggttcccacaagagaggtatacttaaaaagtcccggcatgattttcaaaggaaatcctgccaattatattacagagattcttttaccctttgaaatcctttaaaggagtaaaaatatgaaaataataattgatgattttatccctcagggtggaaaacattgtatcaccaattccctaaaacagatttttacctattacggatatcccatgtcagaggaaatgatattcggtctggcatccggtttgtccttcctctacctcaaccagtcagacagccctatggtaaatggcaggataaaagtatttgaatttgaagaaaaactggcaaaacgccttggtatctccatcaaatgtaaatccggaagacattatcctcagatttttgaaaccacaaagcagctcattgaggaacaaaaccccgttcttatctacacggatatgccgtatctgaaatacttgggcatggatccaaacagccactttggaggacatgccgtggttctgtttggcttcgatgatactgcgcagaaattctttgtaagcgacagagataaccacgattttcccatcaaagtcccctcaggtcagatagctgaggattatcacatggtagattatgcagaaattgaaaaggcccgcaggagttcacacagaccatttccggccaacaacaagtatttgacatttgatttcagcggatacaaaaaggcagaaaaaaaaagtcctgtgtcaggccatagaagaaacctgtaccacaatgctattcccctccgcacaattgctgggtataaacggcatcaaaaagttttcaaaagaaatcctgaaatggaaacagttcagctcccaaaagcttcggctggcaggtaccaccaattattttcagatcaatgaggcaggcggcaccggcggagggattttccgcagaatgtatggtgattttctcatagaatgcgcacctgtttttcaggatgaaaggcttgtggactcaggacagcgtttcctctatgcctcccggcaatgggattccctggctttagatctatggcagttatcccttgacccggacacggaacttttaataaaaatgtcagccgccatcgaagacctttatgtcattgaaaaagatatttatttgtcattgcttgagactgtgaaacaacataccttggaccgggaagaaatgtaacatacgattctggaaacacacttgaatggattttcttcccctctgctttaaccttaaggattatataaaaacaagccgtacaacatttttatctgctgcacggctgtttttcgttactcttttctttattacagcggatacactccgaattcttcccgcagccaccttctataccgctcaagctgcccctcagtatgaaaatagtgttccccctgttccaccacttccaggcggcacgagaagcgttctgtaaatgccagtatcctgtcatactcacacaaatcgtcctcactgccatacaggatacttgtgggagaattccatttcacaataggattttcctttgtatagcagtaatagtcccagtaaagcttttgtccaatgggggtatccagctctccgttttcttttaactgaccggatgtaatgtgaaaccaggccatcatatttactattatccgctccatatccaccaccggggacaaaaacaggcatctttcaaattcctcttccctataagctaggagactgaaatacgcgcccaaactgcaggcaaataatcccactgtgttccatttttctctgacaaatcccaggattactttcagttcttccacacaattctgcaccttacagggaattccttcttcttttctctccccgtgttccggcagatcaaagctaagtacctgataccccttttccgaagctgtctctgccaggatccgcacaggtacatctgtcttgctggactggtttccatgtactgccacgatcaccttgtccgcctgctcaccatatagaacagacggtatcttatctatctgaaaaatctgcatcttcatattacttctgtcctcacctttcctcttccaactcccacagatgtctgtcctttctaaaatacaggcagataagcacacccgctattcccagaaagaaaaacagcattgcagccccggaaccttttccgctcccaaaagcacgcaccagataacttcccgatgcctgtgtgcccattataggttcaaacactttatccacaaacaatccgcctaaaagatatcccaccgggattgtaaaaaactgcagagtgttgcgcacagaatacacgcgtccctgtatttccagaggggtatgggaacggatcagcacatccatattggctgacataaagggaataaacagccatcccagcaccgcccccaaacaccagacctgtgtacttttcccaaaggccagaaaaaagttctctgtactcatggaaaacaaaagggaattacagatgatccgcattctgctcttcggcggtgcagacatggatacccagatactgcctgccagatttgcaattcctccacaggcgttcacccatccaagcgccattttactgcctccgtttctggacaggagcatagccggcagtgccgcgtcgtacatggatgccaccagattgatggccgccagaaaaaggatcaggtccaggatccctctgttctcccgcatatatccaaggccttcccctgccgcttttataagagaacccggccgctccccggataccggcctgttctccgggatccggataaaaaatgcaagggtaaaaaacgcagcggcaaaggttgtcaggtcaatggctatcaccgccccaatcccccaaaaggacataaccgtcatagcagcaatgggattcagcacagtgataagagagttggaaaacgaacgcataccgctcaccctttggtattgttttttcggtgtgagcaggctcaccgccacatccgaggcaggctgctgaatggtattcatcaggccgttcagtccattgataaaatacaggtgccaaatttccaggcttcctgccctcagcagataaaataccgctgctgtactgactgccgcaatggtgtcgcacacaagcatggtatgctttttgttccatcggtcactcaaagcccctgcaaaaatgctcaaaagtacataaggagcataggaacagattgccagaagggaagtagacagcgccgaaccggtctgctgatacgaccagatcactaaggcatagcttgtcatggaactgcccagcgcggaaagcgcctgggtcgcccacagcagaataaaagtatgtagtccttcaaatagtgctttaacgttatttcgttttttcattttgactttgccctttctttcataaacttggtttattcaaagaacgcaaagtctgacggacgaaaaggcattacacccaaaattcgtctccatacaaatccgtccgcatctcagactttgcatggagcttttaaaatgcagagcatcactgttatcatcctctcttcgtttttttgatattaacattaactgcggtatttgtaaagcagtcaggtattttcatgctcttcattcctgaaacttttatctacagataaacttctaacaaaagtatcttgtacagcatcataacaacacgccacatccttttttagtgacatgccattttaaaaattcacgcatggtacacaaaggaggctgccccgccaaagcggatacagcctcctttgtatgtcatgcgtgaattcaaatccatttggagccgcagtttgcggaggatgcggctatgtctatatcatagctaaccaccacccgttttacaagccaccccaggggataattttaaaaaaatttcagtttttcatctgtactttcttctcctgctccggcttagataactctaaaggctcaccttcggcgctgccgtcctttttgcttttatcttccccggtaagcattttcttcacagaaacgatcagcaggatcagcaccgcgatcagcggcagccctgtgagtacggaaatggtttttaccgcctccagtcctccgatcagcattaggccgatcgacaaaagacagaacagaattgcccagaatatcctgttccatctggcaggctcctcatttcccttcagacgcttcatggtggtcccggccagaacataggcacaggaatcaattgtcgttgcaagatatacaaaacagacaatgcataaaaatatcatcatgagcttcggcataggcaaagtccgaagaattgccacaatggcagcgctctggccttggctctgcagaatagatgccagatccactctgtctgtctcctgcagaaacaaagagtatcctccgaatatcataaagcttacacagcagcccagacttccccatatgagttgtccccacacgacatttcttatggtgcgccctctggaaatacgtcccacaaacattcccatcataggcataaaagccagccaccatccccagtagaaaacgatccattcctgcgtaaatttcccgcttccgaaggggtccgtatatgtactcattttgacaaaatcagaggtatacagaccaagagaatttatttccattttgaagatatcagttgtcggtcccacaaaaagtacaatcgccataaagacaaaagccagcactacatttatattgctgagcttttggatccctttatccaatcccaggtacactgaggttccaaagatacagacccagatgaccaatactacaatacgcacaacaaagtcataattctgcggaattccgaatacctcccgtatgatcacagagagtaccggcgctccaatcccaagagatgtggaaatagaccccacaatgccaaagatgaccaacatgtcgatcacgtttcccacaaatcccctggactgctttttaagtacaggttcacaggcaatgctcaggcgcatgcccggttttttccggacaaacatcatataagccgtggcaataatagccggattatagaatgcccaggcgctcagtccccagtggaactgcccgtacatatgcgcatactcatacgcctgcttgctgaatggctccagatcaaaaggagggccgctcacataatagatcggctccagaaagcccaggatcacgatgctcgttcccacacccgcagtaaaaagcatggcgatccaggaaacgttggaatactgcggtttatcctcagcgctgcccagctttacattcccgtgcctgctcactgtcagccagatcaaaaatccaaaagacacaaggcaggcaagcaggtacagaaaacccagtcttcctgtgcagaactcaaatacgcttgaaattatctggttggaaatctccggtgccagatacagcggaataataatgactgccaggatcaccacagccgggatgaaaaccttcttttcaatcttctcaaacagtttcacatcgtgtccctcctttatggatgccgatcattccgtcaagttaagctgccgtatttgacaacgagggcgtcagcaacacctactccttccccttccgggtatacaaacagcggattgatatccagctctttgagggtatccctgtttgcactggcgaaatcagcaatacttacaatggtatcacacagggcgtctatatcacatttggccccgccgcgatatccgttcaataatttaaaagatttcagtgatctgagcatgtctaaggcctccgctttgctgatcggagccgggtacaatgccacatccctgaacacctcaacgaacacgccgcccattcccaccatgaccatgggaccaaactgcgggtcgttattcacaccaatgatcatctctactcctgattttaacatgggaactgttaatatcccattaatttttgcgtcaggacgcttggatgacacactgtccataatttcattatatgcccgaactgcttcttcaggaccatgaatattcagcttcacgccgcccacatcgcttttgtgcagaatatcggcggactccactttcatgacaagggcttcctctgtattctttgcaaattctgccgcttcctctgcagaggtgacaatgacttccttgggaaccggaaccccgtaggcgcccagttctttcttgctgtcatgctcagacagagcatatgtctcattgctcttcttctgtcctaccgcaaggctcaggctcttattatccggtgtataggaaataaaatcagccagatggcggagtatcttaaatgcatagaccgtagggggaagtaccggcacaccgatattaaacagcttttcctggtattccgggttcctggtattttctgcaaaagggatcatggcaatgggtttgcagttatcccctttttcttttacaaccttctcaattccctcatacatatagtgaatagccgggtctgcgatatccagaagcagtgtgtagccgatcaggaccataccgatattggggtcatccattacagtccgcagcgctcctgcgtacaggtccgcgtcataggaaaggcttgccgtcatatccaggggattgttaggtgatgcgtaggagggaagctgctcttttaatgaggccagcgtctcctctgcaaaatccgggtactcgataccgtttaagctgcccacgtcggcacagattcctgtctccccccctgagaggttcatagacgcgaatgtggcctgcttcggcatctgctttaaagtggagagcatcagggacatggccatcagctcctccaggtcatccacacggatcgctccgaactttttcagcacagcatcaaaagccgcatcggaaccggaaaggcttcctgtatgggaggcagcaatggcgccgcccttggcacttcttcccgcttttaaaatgacaacaggttttctcttgtccgcggccttttttagaacagccgcaaatttatccgcattcttaacaccttcgatataaacactgaccaccctggtattctcatcttcaaccaggaagtccatgtaatcctccatctggacgatctttccgtttccggctgatatgctgtaggaaaaacgcatgccggggcagtccatcagggacagacagagctgaccgctctgggataccacgcccacactgccttttctgtctctcttgtcagagataaacgcaaaggcctgcacattgtccacataattgacaaatcccgcacagtttggacccataacagcgattccaagctcttttgctgtgtccatcagttccttttcattggctcttccctggtccgtccccacttcaccatatccgctggcaaataccaccgcaccgccgcagccctttgccgcgccttctctcagaagcgggataaccgtcttctgggaagtacaaatgaccatcatatccacatttcccggcacatccgatacgctcttataacagggaactccaaatacctggtcacgctttggatggataaaatatacatggcttctgtcttccatataagtaaggatattgcggcacacatcaccgccgaagccttccttctcactggcaccgatgactgctacggacttcggtttcagcagttttgtcaaattcataattttttacctcctgtgagagggcggccaattccgccctcctgctcaaacccctttattatttaccttccaccccacggcgataacaggctacattcttttcattgaatttgccttttccctttttttcaaaaaaggagacaatggctgtttccatatattcgatcgtaaacagatcactgtgggcagccagcgctcccagcatgaccaggttggcacccttaggatttttcacttccgcggctatgtctgtggcgggaatctttactaccgtgatatcttccctgtaggttctgttctccggtacaatggaggagttcaccagcagaagccctccgggtttcagacgctcctcgaatttatcaatagccggagtgttcatggtgaacagaatatccgggtgcttggataccggactggcgatcagcttatcgctgatcttcaccgtacaattggcagttccgccccgcatctccgaaccgtaggagggatagaataacacatttttgtcctgttccatgccggcattgatgagcagcattccggctgtcagcactccctgtccgccgaatccggcacaaataatttcttttgccatgtctattcctcctcctttttgtctttaaattcacccagagggaagtatttttccatctcattttttaggtgctccatgctctttacaggagtcatgttcaggtttgtgggacacggggagagcagttcaaccagacagaatccctgtcccttcatatgtttttcaaaggcttttttgatgtattttttacactggatcatccccttggcatctgccatggtccctcttgccaggtaggcaatgtcaaagcctgtaaatgcctgctcaactctgaaaggcattcccattttttcgggatcttttcctctcggtgtggaagtggtgatctggcccggaagagatgtgggcgcgcattgcccgccggtcatgccgtataagctgttgttgatgactacagtcaccacattgtcgtttctcagtgcagtgtgcatcgtctccgccatgccgatggagtacgctgcgccgtcaccgatataggcaagcaccgggttatccgggcgtactttcttgatgcctaccgctgtggccacgggacggccgtgagctgccataactgtgtcaaatctccaggaatcaatatttaaagaaccgcaggccacatctaccacagccagaagtttttcacttaagcccatctcttccattacttcagcgatcagacggactgccaggccgtgtccgcatccgggacagaagccgctttgcgtaaatgttacggtttcaggagctaccagtctcatattatactccctcctttttcagcatttcttttgcttttgcaatgattccgtcagattctggaatctcgaaaatagaaccaaaatggtcaaccggatattttccgccggtagccaggcgcacgtcgtctgtcatctgacctaaaatattcatctccactgtgaggaaggcttttgcattctttgcctcctcaaaggcttttatcgggaacggccacagggtaatgggacggataagtcccagtttcaggccctcttcccttgcaagctcaactgtctcacggcatacccttgaactgatcccataagccacaagtaccagatctgcgtcttccacctggatattctcaaagcgctgttcgtcccgctccatgtcatcgtatttctctctcaggtaattctcataatccggatgggtgtaataaacattctggatcttacgctgctcacagcctttttcacagcccttgatactccagtcaaatttgtcgatgtcgtggtccctgaattcggggatttccacagcttcgatcatctgcccgatagccgcgtcggaggcaatgagaacaggatgacggtatttctccgccagatcaaaagcttccaccatcagatctgcattttcctggacagacgcaggtgccagtaccagtgtgtgataatcgccgtgaccgccgcctcttgtgagctgccagtaatctccctgcccctgggcaatatctcccaagcctgtaccgatacgcataacatccacgatcacagccggaagatctgctgccaccagataggaaatcccctcctgtttcagagaaaatccggggcctgcagatgtggtcagcgcccttgcgcctgctgcggatgcccccaataccatatttacgcctgccagttcagactctgcctggataaatacaccgcccacatcttccattctccaggagagatattccaggatctctgtctgcggagtgatcggatatccgctgtagaagcggcatccggccgccagtgccgcctctgccagagcctcatttcctttaaataatacttttcccataatgaacctccctcatcgtatttcaaatacatagtccgggcatacgcggtaacacatgccgcataccacacatttttctgcatccacttcaaccgtattgtaccccttggcattcacatggccggattcccggatggcctcctggggacacgcattcatacaataaccgcagcctttgcagcggacgggattggtgtaaactttttcttttcccataatttcattttcctttctatgatcattcacagggggtactgctttccttgtctttttcgcgtaccgtcaagagccgcgcatcagaccgcatttccctgttttgctttcttaccatgtctgtagatcaacattgcaagtgtggcgcccaccagtcctgagactgcaaggaaaccaaagataaaattgtatcctgtgccgccaaaagaatccagccactttccgaagagcacagagtagatggaatccggcagatagcctataatagacgcgattccgatcacggttcctgtcatgactctggggattcccgcttcactgactgtggagaacacaactccgtacatcatcatggcaaatgctcccggaattagggtatacaggctggctgccatggggctgatgccggagggcaggataagaaccgctccgaacagagctgccagtatgataaatgccgtggagagccatttacatgtggacttaaatactttatctgcaatgatgcctcccacaggagccagcagcagaagcagatagttgcggacaatggagataaatccggagctttccggggatacacctatcacttctgtcagataaggattgaaataggagatgctggtataaaatccgtatccgcagaagatagtaaaggaaacgatccataccaccggatttttcagcagttttcccacatcacccatgttgaatttcggttccccgccgccggctttttcttcctgtttgtcactgtctttcataaggaagaacagcagaaccgctgcaaggatcgccacagaaccgccggctaaaactgcgcggaagaatccctgttccatatctccgccggctgtcttgtaaatattcagggccagtgtgttggtcagggccgccgtgattccgttgcaggcatagtaaaggccatacatgaatccctgttcttcctctgttccgataatacggacagctttcataagcgcggaccagaacacaaaagccgtgctgaaggaaagtcccatccagatgaacatggcgatcttaaagttcatggtaaaggcatataaataggcaagagccgatgtactcagaagggagatcatcagtgcttttttcggggatactttgtcagcaatgataccgcccggtatgtagaggatcatatttcccaccgtgtacatggtgagcagcaggccggactgggtgttgctcatatgcatggctgcaagctgtgcgtcataaaaaatgtatttcacgtagggcagaaaatagatggaacctcctgccaggccaagtgttatgaccgtaaggtattttctcactttagaattcataaaaacctccatatacatggaatggggatgcttttttcgcatccccaccctatccagcagaataacggattacatatccggagtgtcggatttgtccggtgtgaacagccttctggctacgtcacgggtgaattcacctgtctttttggactcttcaaatacccggcgtgtctgtttgcggatcaagtctactgtgtctttcacaatagctgctgccgcatcctcatcactcatatcttcgatctttacaaggcggaagataaccgcttcatagatacggatgccgcccagattggaaataaagtcaacggctacatcaacaccgtttttacggaggatctcgtctgcttccggtgtggtcgggatattggctgcctccactaacagggatgctttgatcttgtcagcattgtctttattgatcacatcttccagagctgcgggaatgaggatatcacattctttttccagccactggctgttcggatagatctcataattatcttcaaaagcttccttgttcatctcaccttttggaagtctggtagctaccagcttgggaatatccaggccgtccttgcagtaaaccaatccgtttacatcagcgatgcccacaaccttgtagcccatattgttcagggagtttacacagcttgcgcctacacatccgaatccctggataacaacagacgcgccttctttgccgcccttcatcttccaagcttcgtcggctgccgccgcaacgccgtagccggtgatcatatcatacattttgaaaccgtcgtaggtcagttctttttctgctctgtcatgatttacgataccctgatggatatcaggatcttccttcatggcctttgtctggggaataccgattcccaggtcatctaagatccttaaaacgtcggagtaatccacacctaaatctccgccgatggaaacacctgcattgatcaccggtgcggtagcagtcaagaaacgcctcagaacgtccagggcatccggtgctttatagtcatatgcgatccccgctttgcatccgcctgttgtgagggattcacatgccttatatttgtaccccatagtcgttgcaagacggataacctcctcttttgtaaccgtcgggtgcattcttgttccgcctccgcaataatgattaacgaagttgtatgcgcacatccatccctttgcatctgtctctgtgtcgttccattccactactaaatacggtttgtttgccattgtaaaaatcctcccattttttaatctgttctctattacagaactttgttctttattgtattaatttttttactcggcatttcgccgagtaattataatatttctttttactattcgttctgtatttaagaacttcgttcttttttgatgatatgagcatatcacaccttgtttgttttttcaatatcttactttaatctttttcttttttgtgcaaactatccaaattccgctctttattttctatagacgtctttgaatctcattggcatacctcttgaggatctgtacaaaaatgtcacgcttctcatcatccatgcgcagagacggagtgctgatacttatggcgccttccacttttcctaaatgattcaacagaggcacccccacacatttgacgccgaaggtgttctccatattatccactgcatagccgtccctccgtgcgttcctgacttcctcccacagcttctccttatccgtgatcgtataatctgtgaaggcttttttctcacggctcaggatctcctccaccgcttcatcaggcatatgggaaaggatgactttccccacactggtgcagtacattttggagcgctctcctgtcactgatctgccgggcagcatctggccttccggatagataccttccagatacactacctcgtcttcatgtgggatggccagatataccagctctcccgcttcttttgcgatctggtgcatataaggaagcaccacccgggtaatggtaaggctctccctcagcgcgcggctcagggtgaacacagctgttcccagcctgaacttgccggtctccggatcctgctccagatagtccatggccttaaaggtcattaaaatattatgcacgttgctcttgtataattccagcttttcactgatctccgttacacccagaggttgtttttccacgaaacatcccagaatctccagagccttctgcaggctctttaccttgatctctttctcttcactcatagtggtttccctcctaatattcatggcggcaccgcttgttccgtatataagaactctgttcaatattgtaccttactaaaatattaccatttctgcccttatattacaagaccgtgtttaaaaatgacatgcaaaaagccgcatcccggcgttaggatgcggctttttgaacttggagtgtctgtgaattcaaatcagacttcacgtgccgttaataagcggagggaacggcacaaaagccaatactgtaaattttccggtcaacttttggaggaagattaaccgtgatatcatcatataacacctgattgcttcccgcaagccgccccctgggttaaaaataaaaaagagctttcgccttcccttccggcagttttttcacacccgatttccccatcccggggttctctccttggcgtctctctccgggaattctatttcaggaaagaatcaagggccttgttcagccgctccaggctcttttcgtcccccttttccaatgcctcctcaatacattcgtccatgtactgcttcaggacttcctttcccgcgccattgacagctgagcgcacagcggcaagctggatcaggacttcgctgcagtcacggccctgttccaccatacctcgtatggacttcagatggccggaagccctggcaagacggttgaccatgctcttgtcatactttgtccctgtatcttttttatcctctctcatcgcacagttcctttctcactttacccgcctttttcagcaatagatctcttcccctccggccggatcccagacatatccgatctgccgggcagtctctgccgccacgtcaatgtcaatttgatctgccaccatccagagtgtcatatcaagccctgcagccgtactgctgcaggaataatattttccgtcagccgccactctggccccttctatcctctcaatccctgccgtgaacatcctgttccagttcttgtcaagaggacagtctgccagctttcgcctgtacagaagccctgtctgtgccaggatcgcggaaccactgcccaccatcatacaggtatccgcattctctgcggctcttttcaccagattcaaggtgcgctcatcctgccaaagcaaccgccttgctccctttcccccggggatcagcaggattccctctatttcctcggggatcaggaaatctgtccagattttggctccctgtacactgtttatcacatccccggacatagagagataacggatgtggaaatacttctgcagtttccccagtatctctgccggcccgaatacatccatggcctcaaaatcatcaaacagtaccatattcacatccatttttacacctgctttcctctgtagattttatatgattcacctccgccagatttatgttcctggtacacacctgttctgccagagccatgttgtgtgtgactgccagcagccctattttcctcttttccacctcatggagcatgagattccatatctgtgactgagtgatcacatccagcatggtgctcatctcgtccgccagcagaaaatgggttccgtcaaacagagagcgtgccacacagaaccgctgcagttctccgccggatagttcccgtggataccgctccagccactccttctcaattcccagtgcacacagcacctcctcccggaacatgcctgactcctccagaaccttcttcatcttccatcgcggattgatagccttctccgggtgttggtaaatgagctggaccggccagattcccttcttctccataggctttccatccaacaggatttccccctcacagggttccagataacctcccagaagctttaccagagtgcttttgccgtaaccgcttggtccaaccaggcccacgcgttctccttcttctatggaaaagtttacattcttcagtatccacggcccgtttgtatagcggaatcctaaatttttcgcttcaagtcgcatgtatacacctcacatatcctcccctgatctctctcatggggatatctttttcacattcttctgttctgtggggacacctgggagaaaagagacatccttttggcagatatttggcatagggctgaaatccggggatcggctgaaatccattctggggcagggcctgccagagcgccttggaatagggatgacgcagttcctgcatccctctcctgaagtcctcagcctttgccatctctactgtggtacccgcataaaacacggcaatcctgtccgcaatattaaaggccagatcaatgtcgtgggtgatgagcaccacggccttcccctcatctaccagctcacggaatatcttcagtgcctccagtgccatctccagatccagcccgggtgtaggctcgtccgctatgatcagggaggcgttgctgataacagccgttgacaccaggactctccttgccattcccccggatatctggaagggataatatctctctaccttttcatccagatgaaatctcttgaaaatctctttctgggattttttcctgtctttgccgttgtcactgcctgtcacctgttttcccactctcataaggggatccagataggctacagactggggcaccagagcgatctctgtacctctgagtgcctccttcttcttctggtcaagacactctcccctgtatatgacctttcccgtaaccgctgcgttctccggcaggattcccatcacggcatgtgccagcaggctttttccggaaccgctggagccggcgatggctacaatctcccccggtttcacatccaggctcaagttagatattaccttcaggtcatactgctccagtcccctgtcatacatatggaacgctacggataagtcctccaccttcaggatcggttctctctctgttttttctctcttcatgttttactcctattcatgtgcgctgtacggatctaatattttcttcatattttctcccagacggtcaaagagcagcacaatgatcacaagcattagacccgggaaaaacgcaagccaccacatgcccgatgacagatatttcatggattccgacaaaataatccctatggcaggctgctccggtgagaggccgaaccctaaaaatgtaagtcccgactcatgcatgatggcatggggaaagagaaggatcaggcctatgataaactggggcaccatatgaggcagaatatggtggaccgtgatccaccaactggaatgtcccagtctctttgacacacctatatattgctgggagcgtatctggagaacctcacttcttataatacgggcaagtcctgtccagtgggtgactgccaccccgatcagaacgcctttcagcccctttccacaggcaaaggaaatgaggatcagcagaactgtatggggaattcccataacaagatcgatcagccagttgataaagtgatccagccaggaacgtcccgtggctgctgccacacctacaaacaaagcgatcaccgcactcacacttgacgcgatcatgcccacagatatactgacagacagcccttttatggtacgcaccagcatatcccgccccagaagatcagttccaaagggatgctctaaagagggtttcagtgctttcctggaaaaatcagcctggataaggtcatcacttaaaaaagcccctgacagatatacccccaggatcaccaggaaaatcagcgctgcaaaaataatcgttttggtcctccggttcactctcgtccttcttccccgtacaccggacaccactgcggtcatatcactcatttatgtatccctcccttatctgcgggtccacaaccccgtatattatatttgccagcatatttcccacaaagacaaagagtgccgaaaacagggtgatccctaaaagcaggggcacgtcagaccccatacccgccgcagaagccgcggcacctaaacccggataggaaaacaccgtttccgccagcacagagcctccgaacagttcactgaaggaaccaaactgcatagtcacagccggcagcataatatttcgcagaccatgcctttttaaaatactccacccggattctcctctggcttttgcaaaaagaacatactcactttccagcacatccactaatttttcccttgtgtgaagcgccacattggcaaaagacagaaaactcaaggtcagagccggcagtatcaggtggtggatcctctgcagtacggtcacctggtccgtgggaacgcctttcggcacgctcatgcccatgggaaaccatcccagcttcacggaaaaaatcataagaaacacaatgccgatccagaaagtcgggatggaacacatgatcagacagacctttttcaggactttatccggtcctttcccatgaaatgctcccatcacacagcccacggtaaatccaatgatccccgaaaacagccaggcagccgccatgagcgccagagaagtgacaaacttttctttgatgatatccagcaccggccttcggtagatcagagacactccaaagtctccatgcagcaccgactttgcccacgcaaagaagcgttccacaggcgggtcatttaacccccagtattccgctatctttgccctctgttccatgctcacattgggcactgctcccacatactgctgtaccgggtcaaccggagacatactgaccagaagaaagctgatgatgctgactgctatgagaagtgtcaccatgcggagcagatatttccctgtcaatttcatataatatttatttttcattctgcttctccattcgattttctcttataaatcttgtaaaatacgcgagggaacacgaacagccccgaacgtaaaatctctcagattttacgcccggagcagtatttcccgacttattttatttccatgtccattctgcaaggttggcaaccagaggccacgccgcaccgtgcgcatgaattctctgttttcctatatccagcccatcctttacatagtagagatgtgacatatttacatagaacgcccagggcgcctcgcctctcatggatgtacctgtctcaccgtcccactgggccttctgccaccactggtaggaatcctctatggtaagggaattcatggccttgtccagatattcatctgtcttttcgctggtatagaattcaggattgtagaaatccgtcttgcccgcattactgctgtggtacagcatataagaggtcatgggactgtcggaaccccagcccatgatcatgggttctgaaaacattctcttcaccgtgtcatcctcgctgacgccttccactgtgatatcaaatcccatgttctcttttgcctgatttgccacggacatggcaactgcctggcgcatggaatcccctgcaaaatacatcagatgaaaggccagctttgtcccgtctttctcacggatcccgtcgccgttttcgtccttccatcccgcttcatccagaagctgttttgcatagtccacatctgtatctataacagtatcctcattccaccagggcataccgtcgcactctgtataggccggttttgcaaagccgtttaaagcctctgttatgatcttttccctgtcaataccatagcacagagccttcctgacattcacatctgaggtaatgttattcccgatcttgtaaccatcttctgttgttttaccttcatcgggtacggtgggaagtgtgatccctctgttgtccacagattccacctcttccacgtgcatgccgtctatatcattggtggcaatggtcgcggaggtcagtgcgatgtccacatccccagctttggcagatacaaaccgcgcatcctcctcctgtaccagaaacactgcttttttgatggccggctgttccccgtagtagttttcattggcctccatgataaactgctggcctttatcccactgggtcagcctgtacggtccggaaccaatggtctcctcaacagacagtccgaaattatcgctgtatgacttttccggtacgatcccgatctgggctactgtatagataaaggtcacacacggcttgttcagcttgaattctacagttgtgtcatcttttgccgtacattcctccagcatggtaagatccatgtaagttgccttttctttcgtggtgttgaatgtaaaagccacgtctgaggccttcagcggctctttgtttgaaaatactacgtcatccctgattttaaacgtccaggtcagtgcatcttcgctcacactgtactctgtggccaggtcattttccagtttgtcatctccgttcactttcaccagggaggaatagagaggcgaaccggtgtggccgaacccggtgcaggggtcccagctgtccgcgtcatttgaaaatccaatggtaacttcatcctttgcagaggtcccctcctgctcttctttgggagcatccgccttggctgacgcttccgtccccttctgttttgcctcttttgcggaatccgtaccggaatcccctccgctgccgcagcctgtaagcagggatacggtcattgccatacagcagagaactgccgcaatctttttcttcatgtgttctgctcctttttctgttttgtatttactttgtctcttcccggaatatttccccgcttccgggctttcatgaatggagtatagcagagggaaaaatggcccgcaagccgcccccggggttttaaaaagaaggtttttcaaacaaaaaaaagcctgtaatcggcaggttttttgccaactacagacttttatcccatagattttaaccccatcccggggttcagtcttcgccttgagccagttctttataataacagccaacgtgacgctggcagtgtctgcatccccccacacaggtgaagagactgtcctcacatgcggacacgcccgcaccttttaatcccaggcagagttcccatgcctgctggatggctgcttcttccccgtgcagaacaaacgtcctggttccgtcaccggttccgaatccgcttccggctatcaccaccgcttccacaccgaaaaggatctcaaacgctttcagctctgtgatgacagggccgaagagattatacaatccgatcgcagctcccatggacagatcaataccggctcttccgctgtgagcctgggctgctcccagatccgggatcaatttattgatgcctgccaggatcagcatgggtactccctgcatatacgcgccgtggagggcatatcccctgctgcctccgcccagtgccgcaaaagccagcgccgctcttcccatgggatcaatggcatttgctcccacaacaaccaggtctttgtcattgagtgattctgcaaccttctggatactgccgtccacattcactccttttccctgatccagcagcagattatgaggcgcctttgcctttttcagggcagtcctcgtgccgctggcatcaattcttccggaaatgcgcagaggtccaaatcccagttcctccgagagcgcggacacggtagtgcctccgcacagaaggatcttattcttctccagacgctcctgtatctccggcatcctgactgccgcttttgcgatcagacgcttcccttcatttcccgtcaatgtaacctgtacttttttcgccatatttatcctcccaacataaatgcgcatacctgccgaacagctacccgcccgaatctttttctttcggcagacattacatatttcttgttctggggtccagatagtcccgcagtgcatctccgatcaaattcactgccactacggtgatggtgatggccagacccggaatcaaagcaagataagaagctgtccatacataatttctggcagcgctcaacatggctccccactcaggtgtaggcggctgtgcgcccaatcccagaaaactcaatgtcgccgcaagcaatatggaggaaccgatcctgagcgtgacctggatgataatgggaccgatggaattcggcagcagatgccggaaaatgatccgcagatcccccgcccccgccgagcgcacagcctccacaaagcagctctcccgaagtgacatgaactgtgctctcacaaggcgggcaaacacgggtatggagctgatccccaccgccaccataggcgtatagattcccggctgcattaccatgacaattgccattgccagcaagacacttggaaacgccagcagtatatcacagactgtcatgaggatctgatctaaaagtccgccgtaaaatccggcaaaggcccccagcaaaagtcctcctgtgaggcccaggatcacggatataaaacctgccagaagagaataatgcgcccctgtgacaatcctgctgaacacatcacgcccaaagtcatctgtgccgaaccagtgttccgaagaaggcggcattagtttgatggctgtattctgttcatagggggactgtaccagaaaaggccctgctatactcacaacgatcaggagcagaagaatacaaagccccgcagccgcgctggggtttctcaatattttacgaaatgtactcacattcttccctcccttctaagaatacctgatacggggatccagcagtgcatacaccagatccgttatcagattgatcaatgtaaaagtaaccgcaaggatcaaaatacctccctgcacgatctgcagatttcttgtgttgagcgcatccacgatcatcctgccgatacccggccatgaaaatacggtttccgtcacaacctgccctccaagaagcactccaaactgcagaccgatgatagtgaccacagggactgctgcatttctcagcgcgtggacccatatgacctttctgtttttaacgccctttccttttgccgtccttatatagtcctgtcccagaacctccagcatactggttctggtaagcctggcgatattggcagccactccaagccccagggtcagtgacggcaggacaaaactggaaatcccctctctgccgtagaaaggaaaccagttatggttcacggaaaattctatgatcagaagcagcgccagccagaacgaaggcatggacacccctaaaaaggcagccaccatggctatggtgtctcctatcttccccctgtgaatggctgcaaatatgccgatgggaacgcccagcagcactgccacgatcatactacacacagcaagctgaagggttgccggccacgcggatctgaggatttccataaccggcttgttggtcctgtatgagtatcccaaatcaccgtggagcagattccccatatagctcacatactgctttcctaagggctggtccagctccatggcacggcgcagattatccacatcctccacggttgcctgcggccctgccagcgcctccgcagtatctcccggaattgcgtggaggagcagaaaggcacatgtggcagcccccactaatacaatgcaggtaaaaatgattttctttataatatatttcagcaaacaaccgcctccttgacctgtatggcctgcggatgtccgcaggccggtaatctgaatctactgcttagtgactttttccagcataatgtgttctgtcggcagcatctcaatacctgaaatattgctgcggtaggataatgcctgcttcggataatacaagaaggtccaggctgcgtcttccatgatggtcttttccgcctttgcgtacatttccctgcgggcagtttcatccacctctgtctttgcctggtcaagcagcgcatctacatccggattattatagaatgccctgttggaattaggagggaactgggaggaatggaatacaggatataatccctggtccgcatctccggtggatgggctccatccgagcaggaccatgtcaagtcctccgtttttcacctctgacatcagtgcctggaattcccactgccggatattcacatggatccctgctttctcccactgtgcctgcaggttctcacacacctgtgtatccatgagatagcggcccacaggagtccacagttcaagctctatgccgtcgggatatcccgcttctgtcagaagttcttttgccttttccacatcacacgcatacttcatgctggagttgtatccccaggtatacggggagatcggtgagtctgaaaccgtggccatgcccccgaggatatcattgacgatcacatctttgtccaccgcatagttcatagcctgacgtaccttctcgtcctgaagcacgcctttgctgttgttcagggcaacatacatagtcataaccgtatcccccttctggatcgtcacattggggtcactttccagtctgtccgtctctgtcacagggagcctcagagccacatctgcctgtcctgactggagcagaagcgctctggttgcatcctcggggacaactctgaaatacaccttttccacagccggcgcgcctttaaaataatctgtgtttctctcaagaacaagctcctctcctgttttccattccacgaacttaaatgcgcctgtccccaccgggtgtgtggagatatcttccccgtagtcctccagggactttggactgatcactgccgctaccggatggcataactgctgcagcaaagcaccgcacggcacgtctgtggatatgttcactgtatattcatccacggcctctatcttggtaatagccgccaggacagaccttctgggagaacccaggctttcgtccagcactctttcaaaggatgtcttcacagcctctgcgttaaaatctgtgccgtcatgaaattttacaccttcctccagcttaaaggtccaagtgagctggtcctccgagacagaccattcctttgccagatccggctctatctccatttcttcattgaaacgcaccaagttgttgaaaatatttttgttaaaaatctctgtcgcggaatccgtacagaagtgcggatcaaaggtagacgcgtcacttcctgtcagcacaataagctcgtctgccacctgggcagtctggctgtcagactgttctgttttatccccctggttttgttcctggttctggccctgttccccgttctgctctttcttactcccggaatcgcctccgcaggctgataatgccaataccaatatcccggttaaaatcatggaacacattcttctcttcatcagctaaaccctccttgcctttacggcctttcctctgagataaatgcctgcacacattggtgcatcttcttctccgcatcattccatacgcttctttttctcacggcatcctctcgcaccaaatggctctgttccttttgcagctccagcatcctgtgcacctgggacggtgccgctgccccctgacagtctcttctctccactgcgatcctaaaattcttagccttatccacctgctcttttgacagaggcaggccggttttacagatttcacggcaccagttatccagcagatcccaggtcaggtcatcctggccttttcccccgcggaaaagctcactgactgctccgcctaccactctgtgcgcctgcctgaaagacaatttaccttccagcaccaggctgtccgccagctccgtggcatttgagaaacctttatacaagatctcctccatgacgtccttattgaactttaaggattttacatattccgcgctgatcctgcacatgccttttgcggtctccacacactccagtacatctgtccaggccgcagtcatatctctgcttgcctgaaattctaccgaacaggcagagcatatgccggcataccgccctgacatcagccttgcctgggaacgcaccgttgcgcagataacagggttccgcttctggggcataatactgcttgaatcgatcagatcatctgacagatcagcaaatcctgcctcattggaacaccagttgataatatcctccgccagtcttgccagagtaacaagaacggagatcccgatacctgctgcctccatcatataatcagcactggccaccgcatccccggtgtgttcccatacaccctcaaaccccagaagctcttttgtccgttcccggtctatgttgtactcggtccccgacatggctgctgcccccagtggatttttattaaaccggtcaatacactggatgatcctctccgcgtccctcagaagcggcgctgcaattcccgagagataaaatcccatattgacaggctgtgcctgctgtccgtatgtatagccggggaaaatatgatctacagtttcctctgcgcgcttatgcagcacctccacatgttccagtaccgcgtctgctaaaaacaacagtttttcccgcagctctatcctccacatggctgcctccacatcattacggcttctggcaaccggcaggtaactacatatatcctcccctgcctccaaagtgatcaggtgttccaggttgatatacaagtcctccagagaagggtccagctccggaatcccttccccccatccctccatgacacaaagcagtctgcgcgctgcctcttccgggataatgctctgctctttcagcatgataacatgggctttcataacccggaccagatagggaaatgacgtatctgattccttcattttgggcccataataatatttcagaactaccggattgatatttccctgtatctgttcaaaaaatcctccctttttctccctgttctccatttttcctcctaatacttcctttttaaaatttctgtgatctcccggatattttcagaggcactgcttttaagtaccacatccgctatttcccgggatgttttctctcccactatgccgctggtcagatccataaattttcgggtaatatcctcttttgacaaaggattgaacatggatccctttggtgctgtcacagtttccgtatccatacttccatccttccattgaactgtgaccttagcggcactgcgcttttcatctcttctcaggcggttcatgcccctgctttccgtcaccctgaccgttttagcaatggcaaggatcttctcatccctgagacgttcttccgtataatctgatgcctgccccccgcagcccatcaaaccaagcgccacaccgtagggaatgctgatctgtgcggatacaatagaatcctgccggtatatcccccctgccatctctatggctgattgattcacctctgcctgtactgctacaatatccgaaggttctctaaatccatggcgtttaaatatctcataagctgcagagtagggggaatgtacggatttgcaggatgcaaaccatttgtactccacctcctctatggcggctttttctttcacctcatccagaacctccaggcaatacgccttactcatcatgctgtagatgcccccatcctctgcttccagtatataatgcggtcctgtaactccgttctctgccagatatgcgctccatatgccgtccctggctgcctgtccgggatggattcgtttggtcatagctccgtccgcggcaaaggcccagcttccgcctgttctgcttcctgcgattcccagagcgttaatcatctgctgcttatccagtcccatcagcactcctgcagcagcggcagcgccaaacactccgcaggtggccgttccgtgccagcctctttccctgtgatctagaaagtccataccctccgcaattctcactgctgcctctacccctgcggtgactgcccacagcaactgcccccatgaagaatcacagcgctgtgctgcggccagggctgacggcacgcatacggctcctgtatgtaaaatggcatagtggacatcatccagttccctgatatggcacagcgcaccgtttaccatggcggccgtatcctcagcaaacaagtggccggtgccccatacaggaatctcaccgcagcttccaaggtctgcagcagctttgataattctctgcccatcctgcgtccggctgccgtaaatgccgcacccgatctcatccaaaatgcacattctggctgcctgttctgcctccacagactgcagagcatcttcattgtcaaaaagaaatgtaaccagtctctcaattcccgttttctctctcatctattccagtggaaagtgacatgccacgatcctgtctcctatctgccgatacggcggttcttgtttcctgcaaatctgtctgcagtatctgcatctggtatgaaaggcacatccagacggcaagttggacgcggaagggatatccccctccagtatgatcctctgcttttcataatccggatccggtatgggatttgccgacaaaagagcctgtgtgtagggatgggccggattttcaaacagttgttccgcgttcacaacctccgccatttttcctagatacataacccctaccctgtctgaaatatgttttacaacacttaatccgtgagcaatgaagatataggtcagcctcagttctttctgcagttcatccaaaagattgaggatctgggactgtacagagacgtccagcgccgataccggttcgtcgcatatgatcagtttcggattcaagatcagtgctctggcgatcccgatcctctgtctctgaccaccggagaactcgtggggatagcggttataataatcgggctgcagtccaacccgctccagcatctgctttactttttccctgcgctccgccctggtgcccatacggtggataataagaggttcctcaatgatctgtccgatggtcattctgggatccagggatgcaaagggatcctgaaatatcatctgtatttctcttcttacctttttcatctccgcttttgacatctgaaacaaatccttcccctcaaataacacctggccctgggtaggttttgtcagacagttgatgactctgcctgcagtggtcttgccgcatccgctctctcccacaagcccaaaggtttcccccctgtaaaccgtgaaagagatcccattaagggcatgtacggtctttttccctttactccccttactgacaaaatctttccccagattttttacttccagcagaggtgtatttttatcacattctcccattcacgctccctccttatctgtgtgcagcggaaaatgacatgttacccttgtggtcccgatcatctgctggggaggttcttcgcgggagcataattcctttgcatagggacatctgggatggaaacggcatcccttggcaaactggtccggtgacggcaccatacctttgatcacttccagtttctgtctgctgtccattctgggaatgcactttaacaggccaagggtatagggatgtctggggtgtttaaatatttcctttacctctgcctcctccacaactcttcccccgtacatcacgatcacccgctgtgccatctcagccactacgcccaggtcatgagtgataaaaagtatggtcatatccaactcttgtttcaactttttcatcagatccagtatctgcgcctgtatggtcacatccagcgctgtggtaggttcatccgcgatcagcagtttaggttcacagctcagtcccatggcgatcatgaccctctgtctcataccaccggataattgatgagggtattccctcatacgcgactccgggtctgagattcctaccagcttcagcatgtggactgccttttttccagcctcctttttattcagtctctgatggatctgcagtgtttccattaattgatgtccaatggagaagaccggatttaacgaagtcatgggttcttggtatatcatggagatgacattgcctcttatggcgcacatttcactctccgtttttttcagaatatcctccccctcaaacagtatctggccgctcacatatttaccgggaggcgtgggcacaagctgcatgactgacagagcggtcacacttttgccgcttcccgattccccgactatgcacagcgtctcgcctttgttgatatgaaaactcaccccgtctactgccggtattgtcttatccggagtaaaaaaataggttctcagatcattcacttccaatagtttttccaaaatcacacctcctgggaaaaatcagtaaatattaaattgttgtattaaatttctattaactgttttcaattatacctaatcgttttgtttaaatgttcttttaacttgctttgttaagacattaaatttgctgtttttccctatagatgacaggaatcccgaaaaccttattttccccgcagaaattcgtaccgctttcccctttttgatttttgcggttcctgaatcttgcttttttttgtgataaatatgtgttattttgcgattctattgtggtattatttaccatttttacttattttgacatctattgacaaaagaaacggcctgggatatacttttcaaaaagtaatgtgcaatacagagaaagagggggaaaacagatatggagatacgcttttttacaaaagaaatctggcaggaaagtccatttcactttcatgaccagatggaaatactgctcatcatgtccgaaggcgaaaatttctatatccgcgacaagatataccccatttccagaggcagcatctttattttgaacagcagtgacctgcacagaagtgtgccgaaaccccgttccatttaccagtattattccattcgtttttatcaggaggaagtggaaggaatctccacagaagaatttgatctgctgaaatgtttcagaaaccacaaccggttcaatcacatgaacaaacttaacattgaccagatagaccatttgctgaagctgatcaacaagatagaatattatcttgcctcagactgttctgcctttggcaaagacatttttgccaagaccctgctggccgaggtattggtctatatcaactttctctatgatacaccgctgctctcgcaggtacccagtgaggagcagctatctgcttattatcctgttatcgactatataaatgagcacataactgaaaaaataagtctggactgcctcgctcagaatttctatgtgagcaaatattatttaagtcatcgctttaaggatctgactgggatgactatcacagattatatcatcaaaagacgtcttaccctggcaaaatcatatctgcggcagggtttttctgttatgctggccggcgagcgtgccggatttaacagtaacaatcattttatacataccttcacaaaaactgtgggcatatcaccaaaacagtatgccagacagtatttgacactggacagttatgtatcccctactcccccgaaacgtgatatatttacacgctgaaaagcccctgcggaattccttccacaagggcttttttatagtagcgagagggggacttgaaccctcgacactacgggtatgaaccgtatgctctagccaactgagctatctcgccgtctgtaatccttctgctttttggcaaaagaatgggaccaatagggctcgaacctatgaccctctgcttgtaaggcagatgctctcccagctgagctatgatcccatgacttttatttgattgtatgctgcttgtacagcaagtagcgagagggggacttgaaccctcgacactacgggtatgaaccgtatgctctagccaactgagctacatcgccatatccttatgcgttccgcataaagaatgggaccaatagggctcgaacctatgaccctctgcttgtaaggcagatgctctcccagctgagctatgatcccattttgttttacagtctttgccatcgcttgactgctttgctattataaccttaaattgtgtcaaatgtcaatacctttttttcaaaaaaatacaaaaatctctttttcttccatctctaatatctggcagccgcaaagcatggaaatttcggatatcttcaccggaatttcagaggaagggtactgtattgatcagaccgtttcctccatattcctccttatatctccttatgtcacaatatcacaccttctccaaaatcctctcccggctctttgcctggagctccagcataggacggtaaacgtagtctctctaaaccgccctggatttctctctgtattttataggcgacaggcccgtctgttttttaaatgccagagagaaataattgatttcatggtatcccacagcctgcccaatttcccccgctttcagatctgtgctctccaagagttgttttgctttctccatgcggcagaacactatatactcattacatcctttccctgtaaattttttaaagagctttgaaaaataattgggtgaaagatatacctgcgcagctaaaccacccactgacagctcttcctccagatggttcttgatgtaggtttccacttttctcacaatctggtggccgccctcctcctgatagaataatttttcaatataatcttttgtataagaaaaaatctcttttctctggctatggaggatcatataagaaaaagaatccagatttcccttcttctcctccccgcaattactgacaactgcaaaatacagggtggataccaattcaaaacagcatctgcgcactaccgagtcagacacattataagaatccgaagcaatttcaaagatatccatgatccgggctgcctcttccacatttcccaattcaacaagcatcctgttttttaactctgtaaaagtatccatgaaaagccggcgtctgttttttgctttgactgtctgggtgacctgctggagcggcatggatgactctatgagatattgcgcactgttgtaggaaatacaaagctcctccggctctgttacaacactccccaggacagccttcacacgaatgtccagttcttcccgcagtacattgacgatctcctccgttttttccacggcctccatattgctgttatctccgaacagcaaaagaagtgccctgtcctgcctgtcgaaaaacgtgattccttcctgatgtgcgtcgagaagtcccatacagatattgcggatcgtcatatttaaaagtccttcggcaataccgtctttttcctcatcctgtatttcacatatgaggatcaccaactgcatggtcttgccgctctcaatgccataggctcctgctgcggataccagatcttttgcattctggtcatagatcaggcctctcatgatgttctccaggatttcctgctgacggcttccggcagtgcgcaggactgcttcctgctccttctgttttcgcttctctccttccagttgttctgtcagtttacggatttccttctcaagggtcttctcgtctacgggttttaaaaggaactcttggaccttcagtctgagacatgttctggcatactcaaagtcatcgtatccggtaagcaccagtaccttcatttccggcaggatctccctgacctgctctatcagctcgatccctgtcatccgtctcatattgatatctgttatcatgatttcaggctgtttttcggcaataatttccaatgccttcctgccgctggacgctgtatagacctctccgattccaacctgctcccatcggatcgtatctcgtatcccttcacgtatcatcttctcatcatctacaacgattgctttatacatgatcttctccctctgttttttgctttcccgcaggaagagtaatctccaccgtaacccctccctctttattcattttataatacagtccatatccttttccaaaaagcagttcgattctcttatgtacattgcggacgccatatccaaagttctcatcatactctgatatggacgcgtttatcctgtcgatctcctcttctgtcatgccgataccgctgtctgagacagagatcacggcgctctccccttttacttccgcacctatcactaacttacctctcgtctcatcttctatcctgattccgtgatatatggcattttccacgagaggctgcagagtcagttttggtatctgaagggaatacatttccggcgctatcctgaactccctctcaattatcgaaccatatctcaaattctggatcgtcagataactctcaatatgagcaatttcctgtttcagaggtatgatatccctgcctttgctgagacagagcctgtaatagttggctaaggcttttaccatagtagaaacctgttcatcccccctggatgtggcctgccagtggatacattccagtgtattatacaaaaaatgcggttttatctgatcctgaagggcattaaagcgaatttgctcagcctggtgctgctcaaactttacccggtccacaagctctgtcatctggtccatcatatagttgaagccctgctccatctgcttaaaatcctcgcctgtattgtcaagggtgatcctatgttccaaatccccttcagaaacacgtctcataccgttcaccaccttttccactactctataggaatagcggaccagacggctgcctgccgctatgccggctatgaccatcagtacaatacatacacacaaaagagccactgttttgagactgtcgttgtataaggctttataagggatcctccccaccagataataattccatatgcccattttccggtacacgaacagagacttgtcttttttaaactcccctttttctccctgaagctcctccataaaggcaaatcccgtgcccagcagagatttatcaccggcggagaagatttcaccactgctgtgaaccatcatgatttccagaggcatctgcgcgtgatcggtatctgccatacgctccagaagatttcccctgatgttgatacaaaccatacccaatagattttttacatggtttacatcgtaaaggggggaatataaagtcatggaatactcttccctgccattgtaccggtctgcgtagctcaggatcacatctcctttttttgccagcgtgcctgcctgatagtcttcccggatctttctttctaatccggcgtattccagtgatgtctttcctttatatgcgtactcctgtgtcctcacatttatgatcgccatgaaattaatattggactgtacgttcatattattgtggatggtctgtctgacctgttccagaagctccggcgctgtcctgtctttctgcctgagaaatgattttacctgttcatccatcataagtccttttgccatatcataatatccggaaagactcatctgataatcatttgccagggtttccatctgtatctccgccaaagaacctgatttttccgtaacgatttttatagaagaaaaagtggatatccccagtacgcacaacgtggtaactgtaatagccagtgatatgaagatttttattttcttatcaaaattatacgacatgtatttttttatcattcttctcattttcttcctcatctgtacgtgtttacgccgaaaaaggcatgagattccccatgcccttttcttcttattctcttttactcttctttattttccttcagatatgtctgcatagcctcctgcagtgtggcatttgcctcctgtggtgtaacagccagaccgaagatttgctgacaggtatccttgtgcacctctgccactgtgggcggcatatactggtcatagaaaatctgcatattacttgctttgttggctgcttccagaatttgttttaccacaggatccttgataagttcccctgcattcttaaccggcggtattttgttttcttccaccatcttctcaattatctcatcatcataataatattcacacatttcaaaggcagcttttaacttttcgtcttcacaattaaatgacacaaaataaccgctggtgccgatctgtatggaggcatccgcatcagaaccatccacagccgggaaggaaaaccatcctattttcttataaaattcctcattatcactcttgaatgttcccgtattccaggaaccacccaggaacatagctgctgactcctgatagagcaattgctttgcctgcccgtcatcctcgctgagactgttcacaccctccggaaaatatccctttttaacccattcctgaatcttttctcccgcgtactcaaaactttcatcctcaaaagtaccgcttccgtcaactgccttctgaataggctccagaccgccttttctcgttgccaggctcataaaatacatggaaccggtccattttgacgcattcgccagcgcgaatggggtgattccattttcaaccagagtgtcacatacctgctcaagctgggaaacggtctggggaacctccagattgtattgttcaaatatctctttgttataaaatacaccgctgatggtcaactgcataaacggaaaagcatataattctccgttataactggactgttcaatggcgctgtcaatgatcctgtcttttacaggacttgcgtccataagatcctggatcggctgtgcgtagcctgcctcaatgtattccttcatagggccgcccacccaggtgacatatacatcggggcattcatccgcgctcatggagatcacaagtttttctttgtatgtatcattctggatcgcctcactggtgacatgatatccactgtctgttttctcattgaacttatccacagcatatttgagtatgtctttatccggattttctgttccgatattccaatacacgatttcttcttttcccttatctttcgccgcagacggctcgtctttgcctgaacagccggcacaaagagacattaccatagatacgatcactacagatgccgcaattttctttttcattctttttcctccctgatatacatttgctcatacctgttactgttctttattatatcagggcagttcagaaaaatatcttaaataaatccgcatcaatctataataatcagccatcttatcacagaaaagaaaaaaatcaccagatataaaatgctgtttttacaatttcctgtattttttatggtcctcttttatccgtgccatcactttcggctctgccgccagcttatagcccagacccgcaatgatttccgccccatctcttaataccgttcctgccgcctctgtatgcagaagccgctcaaattccctgtcgtggatcacaatctctttctttccccctgtgatgtctatcatggggtgaaagaccggtattttcatattcacattgcccaggtccgtggagccgcccggccccttggatctcaccgtctttcttcccgtatccagaaacagttcccgcattatgccatccatatgatcgttccagaagatttccccgtaatcaggataccgctggcaccattccaccgtagttccagtagccatagctgctccctctgcacaggtttcggatatcttgttgagtttccacaaattctccacagtggcagccctgtaataataatccagacacacctcatccggaacaatattgggagctgctcccccctttgccacaatgccgtggaactgacagtcctttgtaatgtgctggcgccacatatccatagcctccataaagaggcgggccgcgttcagcgcgttcaggccctcctctggacaggcggaagcatgggcggcttttccgtggaatgtaaaatatctgtcattggatgccagtacctgaaaataagtgacattctcattgttcagatgtaccatggccgcatactcgtagccgtcaaagcctccgttcccggtcatataacattttccgcctacaaactcctcccccggcgtgcctatgagatcgatccgcatcggcaggtcgggatatgcctcccgcagagcaagtgctcccagtatgctgatggcacagctataagagtgcccgcatgcgtgtcccacctcaggcagagcgtcatactcacacaaaaatgctgcttttggtcccgtaaaatccttttttgccttgtctacagccagaaaagagtggggcatccccgcatacggcgatgttatctcatatcccatttcttttagaaaccttgtgatatactcacaggactccttttcctccccgctgatctctgggtgttctgtcagatgatccgcaagcatcctggccttatcaaaatatttcccaacctgatccaaaatcgctttttctatcatatccttctccttaaatcctgttatttttcaaaatcctgatacattttgctggcctccacccctgtgttattctggtatttgccgctcttatagaggtcatattcgccgtcaatgtcatggtaatagatctgacacacctccacattgggatatatcttcaccggatggatgcagaatatctccaaagtccaatgtcccgcaaagccgatatccccaaatcccgcactcacatggatgaaaagccccagcctgcctgtggaagaacggccttccagcataggcacataataatctgtcctggtatattcctgcgttctgccaagatacaacttgttcggctccagaaccagcccgtcctcgggaatggtcagctttttaaccggattgggtttcttcatatccagaaccggtgtatcgtacaccagaagctcatctgccagtgaaagattatagctgttgggattgatccttttttcatcaaagggttcaattataatttccctgcccatgtgtttcctgatttcttttcctgataatatcattgtttttatcccccaatactgatttagattcctgtaatcaaaatactgtcttgagtatatcattactgcataagctctggcaagagcatcccctcacggggatatctgccggacttatgctgtgcaaaaaaatgctgcctgataccatgttggataccagacagcagacgcatttaaaataaacgtcatgaaaaataaatatcaggaataaaacagattcggcagccatgtggacaaagccggacagaatatgatcagcagtaggacaaggaacatggccggaagatatttggcgcactctttcgtcactgaagataccggcagtcctgacacatctgacatgacaaacagacatattccaaaaggcggtgtgacaatgcccgaaatcagggcaactgtcatcatcacgccaaaatgtacctggtctaatcccagattattgatgatcggcataaaaataggcgtgatcagcaaaatggcggctgtagtgtccatgaaacacccaacgataaccagtatgacagccaatacaagcagaacgaacaccggccctgccgaatacagcggagacaacatattttgcaacaccgtggcaagcccttctttggtgatgatccatgtgaaaaatcctgcaattgcaatgatcagcataaaggttcccgatgtctccaccgcgtccttcagcgcctgcataaagcttttgaatgtcagctctttatagatgatccccagaataatagaatagtcgatagccacgatcgccgcctctgtgggtgtaaatatgcctgtggtgatacctccgataatgatgaccggcgacatcagtgccggaactgctttcagcagtttgatggggatttcttttgtcggaattttggtaaccggccagtttttcccctctttagttgtccttgactggacaaagatggagaccatcagagacagccccatgataatgcccggtatgaggcctcccaaaaataatttacctgttgagattcccgctgaagcgcccagaaccaccatggcgacagagggagggatcagcggccctatcacactggatgaggctgtgataccggcagaaaaagatttcttatatccagccttgttcatcattttcatctcaatagctcccagaccgccggtatctcccactgccattccggacatggaggcaaacatcatgcttgccacaacattggcataggcgagtccgcctttaaatcttcccacaatggcaagggccgcgtcaaagagacgtgttgtcactccggcagaattcatcatccggcctgaaagaagaaaagccggaagcgcgatcagcacataggaaaacaggggtgttgtcatagaatgaggaagattgacaatggagacagatcccccctgcatcagaagatatacaagcccgggcagccctaatgcaaaggctatgggcattccaataaaaagtaaaatcaaaaatgtaagaagcagtatcgttatgtttagtcccatttttttctctcctctctcagcctgtttctgttgtgtaggtgccctttaccatctcgatcaattccactgtgtagacacaaaccatataaaaagagctgaacagtatgggtatataatagagatttttaggcagatccaggttggtactggagtgccccatcattttcggctgtaagataatggctccaaaaaacatgaccgccaacaacagaatcatcaaagctctctggcatatcagtaaaatcttattggcctttggtgataactttgtcgtcagaaaatccgcactcacatgcttcttgttcatagccgccacgctggccccgcaaaaggccaggtagataaagagaaaagtacataactcttccacccagtttaacgggctgttgaaaaattttctgcagataacccccgctgtcacagagatcatgatcaccagcatacagacaacccccatataccactggaccgtaccgccgatttttataaattttttcacaaatttcatagcttaccacctcccaaatatcagactgccgcagccccatggccgcggcagcacatccgcgttcagttgatcactcagcaagcgcttttatatcttcaaaaagtccctttttccaggcgcctttttcctccagttctgcggctttgtcagcgatcacatcagacatttcctgtatggcttcctctgacggagtggtgaaattggtcccctcggattccattgtctttttgtattcttcggatacctttttcacttcatccgtataccagtctcctgcatcattggcagcttctgtcagcacttttttctgcgcactgctaagctctccatacagggcatcgttcatataaactgccgcgttgtcacggatatgttctgtcagggtgacctgttttgtaggttcatagaatttcatggtgtaaatggaatccagaggagattcacatgcgtccacaacgccctgctgaagggcaaggtaggtctccccccaggctacctgtgcggttcccagtccaagcgcggtggcagattccatataagacttgatgtccggcacacgcatcttcaggccttttaaatctcccagtgactgaatttctttggaacaggaaatagatctgggagatctgagccagttattggccaccacgcggattccctgctggtcaatgagctgctgctccatatccgcattgatatcgctctccaggaattttctgtaatgattttcatccttaaacaggaaaaacatggaggtcacctgcgcgtcatctacaaatgtagagagccaggatccggcatccacgaacatctcctgggttcccagagatactgcctccatctgactggtagcatccccaagctgcgccgccggggacacggtaatggtgatcgtgccgccggatttttcttttacctcatccgccattttttgcattgccagagtgactgtatcctctgccgcctgaattcccccggctgtaatgtcaaaggatttatcctgactgaaatcataggattccacatccacctctgactgtccgctgtccccgttatctttcccatttttcccttccccgcagcctgacagcaccatgccaaacacagccataccgaaacacatacaaaccagttttcttttcatttgcttccctccattttagatttaccttatccttttagattttcttagctctcagttacccgttcctgcccttgtctgattatctgtttctgcaccccgcataaagcagaaattttcagtgatttcactcagtttacaggtaattcttttaaagttattgtacattatcgctaatttctttaccataacaccacagcataaaaatatatttgatttttgtgttatcagcataattaccgcaccgtgctgcctggattccggaaacaaatgggacatcggatcttacagactgctacgccctattatttttgataaaataatggagatattccaggaattcccggtctgccacctgctgcatgggatttactcccagaagttcccttatcttgttaaagcggaataccagcgtatttttatgtatataaagttctttgctgctggcattgaaattatagttgtttttctgcagggattccaccacatccagtatgttctccctgcccttatcatccaggagctgttcataaaccccgtaaatatcccggtattccaccatagcgatcagtgattttatatactcgctcacgtgttcatagaaaaagccgatctgtcctttcacacggtccctcatccagatacagtgctgataaccgatcctgtatttttcaaagcggttctgaaaagtcccagcaagaaactggtatttagcccctgccatatccaggtaatttttgcaggaagcaaccgattccgcaatgatctctttgtactggcagagactggcgggatccggcttaaagcttttgaaaatgatcacatttttatcctgcaccacagatataatatcctgatggctgtacaatgcgctctccttcagctttctcagcactgtgggcatatctgccatctcatccaaaaaaagaaggaccggcagccgtacgtaggattcctcccatcccagtgtctctgcatcctcccttaatttctcaatatccgcaacctcatttgacaaaatgccataaataaacctgtccttcatgctttttcgctttgcgttcatctcatgctgtgactcaaattcgtacatggtctcaatggcaaatttcatcacctttgcaatatcccgcacctcatccggctcgccggtcacacctatggctcctgttctctttcccctgtgctcgatgggcagcattacgcccggctttacccccaggtattttcctccgtccgggacatcaatgatctcctcgtcaccatgaatgatccaatatgccacctcgtgaaaattgccgatccgctctgcgtctttgctggctatgatcacccctttttcgtccatgatattgatattgtattccgtggactctcccgcttttttaataaatttttccgccaaaaaattatccagcaatccaatccctccattctatctgtttccaattccaatctcaaaaaagattcccgtctgcaaaagagacaggccgctgcccgaaatttaaatgcacagacctactgtatagttaccagaattcatttgtatttcatgataacattccgaaaatatcttgtccatagccaaaagttttctggaatattttggtatgtctttgtgttttcacgacacaatttcctgcgccttttttgttttcctgtcccatgggaaaccttatttttttatgctatactcaacaaaaatcaagcacgaatatccatctaccccgcagtggataaaagtaaaggaggattttatgacaccaaaagaacggatactggctgcgctgaacgggcagccaacggatactctgcctttcattccacgtctagatatctggtacaatgcaaatgccggaaatggtactcttcctgcgccttatcagcatgcaaccctgagggagatggtggatgatctggggcttggctatcacgccattattcctgattttaaagattttacagacccggagcagggggatctggatgtgggacttggaatctaccacttaaaaaaacatccttaccggataaagctccataatgtaaaacgtacgtatgagcgcagtggtgacggtattctcaaagtaaaatacgaaacgcccaagggagacattaccaccactgtagtccacagccaggacatgaaaagaaacggcataactctgtatgttataaaagaacacgccattaaatccaaggatgattatcctgccatgaaatatatttttgacaacatggaagtgattcctgactatgacaattatactcatttccagcaggatttcatcggagaacggggtgttgccgtggcattgtctgctatgtgggcatctcccggacattacctgatcaaagagctgatggcatttgatacctattattatgaacaatatgacaatccggatgagatgaacgaattcatagagcagatcacgcctttttgcagcaagctcttcgatgccgcattaaacagtcccgctgaggtaatactctccggcgccaattatgatacctcatttactgcgccgtctatgtttgaagaatatatcatgcccgccttaaaggaacaatccgacagggcacacgcccgcggcaaattcctggccacccacacggatggtgaaaatacagggcttatggagctttacctgaaatcaggatttgacattgctgattccatctgtcctgctcccatgaccaaaatttctctggaggacacacggcgtatgttcggccatacctgtacagtctgggggggtatcccttccatttccgtgctggaggattctatgaatgacctgactttcaaacggtttgtggaagaaaagttcgagaaccttggaagaggggaccacctcatattatccgttgcggacacagtgccccctgccgccaaatttgacaggatcttatatctgcaaaaaaaggcaatggagttcggtccggtcaaataacagagaaaaaaaccgcgtggcatattagctggtgccgattaagggaactaaaaaataataaggcagacggctaaacgggcaagggtttaaggcaacatgcacgaaaagggacactgtttttacggtgtcccttttttcgggcagccgtccccaggaaagggggcgaaaacatggccgagccgggcgcattggaatacttctatggcaccgaggcagagcaatataccttttatccgattcccaaggtgttgttcaccgcccccggtttcaaacagacaactggcgacgcgaaaattctatatggcttgatgttggaccgtatggggctttccgtacgcaacgactggctggacaaacaaaaccgggtgttcatctacttcacagaagcaggaccagggccgccccaccaaaatctatgtcaagaacttcattcggagggaggaagtcaatcaatactgataagaataatactgaattgaatgataccgatccatctatctatccggcagcaaggccagcctcagggaaaaggcggcgttttgttctgcccatgaagcggatctgctgttgcatgaatcagtcaaacgggcctttaacgatttaggcacaaagaaactgcccacggtcaaaattttgcaggcggaatatgctgatttgcttgcaaagaagaaaacggcttatgaggatttaaacgcttacgaaaagagagcctggaattgcagatagtcaaggcaagtgtagacgcacttctgcgtattgagaggttcaggactacgaacaggaaaaaaagaaaaatcaggagcaggacaggtagagccgcactgtggttttaccgccttgtctacctaaaagcaaaagccgggattggtgtcaggggcgcgccgtggcgcgttcattttacccttgataccgttctcggcttttgctatgtccttgacctttaagcgtccgccagggcgcggcagccaccatgctctgcatggtgttctgcccacacatttctgtgttgggccgggggcttggggaactcaccaacaagcggaaaagaatatccttttccattgcttgctaactaatatttttctggaacccgaatattaactacatgataaaatttatacttttctaccatatgcttcttcatacgactcaaattgtaacgataacaatctgctatgctatccgcaaaggcgtctgcattaccttcccttaactgttgaagcgcaagaatgacttgcttgttgagatgtgaaagtgtatgtttcttggacggataataagcaaaatggtgtccccattcaagaagatgattggtttcagacaatataacatataaaggttctaacgtggtatttctcattatggctttcaaaatatccgacaaataaatagagtcaaaagaggtaaatctatctgccaactcgtccagttcttctttagtaaactgtggagctgcagctaaagcggcaggacgaataattagtaccattaactgcaaagcgtgaaggtaacgtagtgctttttctacatatccggaattaagagccaaccgatgaagtttcgtatcatccggttctatcactatagtgcctttaccatttaatgtctttacgaaacctctttgctcgagctctgataatgcctttctgaccgtcgatatagagacctcatactggttggccagttgcttttcatatggtagaaacattccaacagaatactctccaagaccgatttttaaattcaagtcatcaacaatttttgagtaacaataatcctgaccacgcatggggttccatgaaaacctcaaaccagtttgtgaatcacattttggggtggcctctgacagataatttaaggtattttcaatgaattccgtaagtttctgatacatatttgagagcaagttgtactttatgtgtggatcatcgccttttaagacatctggaatgacattggctacagataccgcttcctgtgaaaaatgcttagagaaataagtacactcttctgtaaaaaatgtaagtttattataaaggccaaacgtagagtagagttcgctgattagggaattaccgcctattcttaatatctcatatcctaatttagagggaggacgccatccaccagcagtatatcctaaacgcaatgctttcacagcctgtttatagtaaggcagtacctccacatcacatccctgtaaggaaaaaaccaaaagtgaaggcagtattagagcaaaagtttgatatacctgtaaaatacattccttttgttttagaatctcaagaacagtgcttgatgaattacaggtatcttttgttgaaacaacaatcggcgcaaggcgaggccggatatcaaccagtccttccgccctcaatgcatcgaaaacacggttaatcgtatacctgctaacatggaattgttcgcaatacatccttgaagatggcaaagcatttccatgaggtatctgtccatctaaaatacactgcttaatttcattatatacaaattcaaattttgtctcttgtggtttcataactcgcctcctatctgtctgattatatcatgatgagtctattttgtcagtataaaaagcgcttacctatttgtacaccttaccaatatggatattgccagtatgtaaggataacatttataataaaaatgcaaaattattaggaaagcgttaagtatcatggataaacaaaaaattttaattgtggacgattcagaaatgaatcgagctcttttggtagatattttggaagagcgatatgatgtggttgaggctgagaatggtgtagaagcaatttctctcctttcaaagcaaagggctgatttctcccttctgcttctggatattatgatgcctgaaatggacggatttgaagtattagcttgcataaacaaataccattggaatgacaccttcgctgttattatgatttctgctgatgacactcctgctaatataaagagggcctatgacttgggggcttttgactatatcagccggccttttgattcaaccattgtccagcgtcgaatttctaatacgatgtttttatacgcaaggcagcagcgccttgaaaaaattattgcagaacaatttcacgagcaggaaaagaataataagttgatgatctcaattctgtctcatattgtggaatttcgtaatggagagagcggcctacatatactgcatgttaatacgattacaaaatatttgctgaagcagttggttcagctgacagatcaatatcctttgtctaaagcagatatttctttgatcagcactgcttctgcgctgcatgatattgggaaaatctcaatttcagatgcaatattaaataaacccagccgacttacggcagaggaatttgaagtgataaaaaagcactcagtgatcggtgctaacatgctgttagacctgcccatagagcagcaggaagctccgcttatcaaagtggcttctgagatctgccgatggcaccacgaaaggtatgatggcaatggttacccggatggattaaggggagacgaaattcccatagccgctcaagcggttgcgctggccgatgtatacgatgccttgaccagtgagcgatgctataagaaagcttatccacatgaagaagctttgaaaatgattttagaaggacaatgtggtgcatttaatcctacccttttactgtgcctgcaagaaattgcagatacacttgaaaacgagctaatggatgcctcccaggaacaagaaactaaaaatattcaggatataagaaataaaatagactacgataggctgttttcctatgaaaaatacaccgtcttgtctcgcaaacagcagcaactgcagttattatatattgattccttaaccagtatttacaatcgccgctattatgacgagcattttcaaggcgcagatgatattcaggcaatggtcgtaatagatgtagataattttaagtacatcaatgataattatggccacgatgtaggcgatatcgtattgcagagcattgcacaaactgttttatcctgtgtgcgaaaaacagatgcagttatccgttatggcggcgatgaatttgtaatcatctttttcggtatacctcaagagatatttgaaaaaaagctggagaggatcaggtattctgttgatggtctgataattgatggacatccagaactacatatgtctgtaagcataggtggagcatatggaagcggaaccgcaaaaaaactgttcaaagttgcagacaatatgatgtatcaatcaaaaaaacaaaaaaatcaggtgaccatttgttttctgaacgagatggtaggcagcgcagacggcatttaaaaaggaggaattgtgattatgaatctaaaagattgttatataaaatttggcggccattttgatgaagtgctgggtagactgcgccgtgagcaaatcgttcagaaatttatgtataaattcctggacgataaaagctttcatttgtttgaagcgtctatggagaataaggactatgaagaggctctaagagccgttcatacactcaaaggaatttgtcagaatctttcatttaccagattgtttgaaagcagtagtttggtaacaaacgcattaaaagaaaacgattggaataaggctgtcgatatgatgccgaaattatcaaaggattactatgaaaccatcaatgttattagagattttaagaattccagggaggaataacatcaatgggaaacagtaaaaaaaagcattctgtaacacattttctaataggcagttttattgggttaattgtctttagtattatggttttcagtatgctcggaatttatatgagccgaaaaagcaacaaggctattaatgaagttgctcagatttatatgtctggaatgaacgaacaaatgtccagacactttcaaactgtcattcaattacgttttgatcaggtcagcggcattgtttctgttgtctcagtagataataacgaaaaagaaaagttatatgaggaacttgtttacaggacgaaggtcaggaactttgactatttagcactttgttctactgagggagattttcagactctttatggacaatcaatacaaccactgaacccagccccctttgtagaagcattagtacgaggagaacaaagagtcgctttaggtagtgattctgccggaaatatagtggtattgtttggcgttgatgccactgattaccctatgcaggatggcagtatgagcactggactggtagcagccgtcccactggagtacatcattgatttcctttccttagagaatgaagagcagctgatatattatcatattatcaggccagacggtagttttgtaatacagaacgacaacactgagttgtggtatttctttgaacaactacaaaagcagcttaatgctacagcaaatgagctatctgtagaaaattctattaaagaatttggtgctgcactaaagaatcatgacgaatatagtacaacatttgaagtgaatggtgaaacacttcaaatatatggtaacccattaccctgttccgagtggtatttagtatcggtaatgccttatagtatattgaacaaaaacgtggacgctctggaaaacctgcgcatatttatggtaggattggcctgtgcttctatcttgatttttctatcattgatttttattcggtatttcttcataacccgttctcaggtgtatgaattggagaaggcccggcagactgctcttgaagcgaacaaagccaaaagcgaatttttagcaaatatgagccatgatattcgtacacccatgaatgcaattgtcggcatgaccgcgattgccacagcccacatagatgaccagaaacaggtacagaattgccttagaaaaattacattatcaagtaaacatctattagggctgatcaatgatgttttggatatgtctaaaattgaaagcgggaaattaactttaacaacagaacaaatttcattaaaggaagttgttgaaggaatcgttaatattatgcagccacaggttaagacaaaaaggcaaacctttgacatacatgttgaaaatatcttaaccgaaaatgtgtggtgcgatggagtacgcttgaatcaggttttgttaaaccttttatcgaacgcaacaaagtatacaccggagggcggttcgatacaattatccctctctgaaaaaaaatctccgaaaggagaaaactatgtccgaattcatattaaggtcaaggataacggaattggtatgtcgccagatttcctgaaaaaaatatatgaatcctatagccgtgcggatggagccagaatacataaaactgagggtgccggtttgggaatggcgattactaagtacattgtggacgcgatggagggaaccattgatataaaaagtgaacttgataaaggcaccgagttctttctcagctttgattttgaaaaagcggttgctgaggagatggatatggtccttccctcgtggaatatgctggtggttgatgatgacgaattgttatgtgagacagcaacggacacgctaaaatctatcggaataaaagcagaatggacattaagtggagaaaaagcgataaatctggtaattcaacaccataaaaaaagagatgattatcaaatcattctattagactggaaactgccaggcatgaatgggattcaggttgcaaaggaaatccgacgtaatttaggagatgaagtgccgattttgctgatttctgcatatgactggagtgaatttgaagcggaggctcgtgaagcaggtattagtggttttatttccaaacccctttttaaatccacgctgtatcatgctttgcgtcagtatatggacgctgaaacagaaaatgatcagacattgaaccccaatatcgatctatccggacgtcgtattctgcttgctgaggataatgaactaaactgggaagttgctaaagaattgctatccgatttaggggtggaactggattgggcagaggatggcctgatctgtctggacaagttccaaagatcaccagagggatattacgatgccattcttatggacatacggatgccgcatatgacagggtatgaggccacaaaagctatccgtggactgaatcatcctaatgccctatctgttccaattatagctatgagcgcagatgctttttctgacgacatacagcattgcctggagtgcggtatgaatgcccatatagcaaaaccgatcgatgatatagaattgacccgcttactaaaaaggtatttaatctaaatctagcactaaaagcgcgtgtccgaaggcacgcgcttttcagactgtagacaaaacggttcgcaaacatgacatcgcgaaccgttctgtctacagtctgagcaagggcagtatccacgcgatactgcccttgcctttgtctatttattttttgaaaattgtatcgttcccctttaatttacaggttctctaatctcccatagataagagggataaaccctctaatacaaaaatcggaggtgttctattatggtaaaagccatcaaagtaattcatctggctcccggggaatccgttttaatcacagcggccctggccctacgccaccttgtcaggctaccgcaagctgtccttatgcctgcggcgaaccaaaacagttctgtgatactcatgcaaaacagacgccgaaagagatcatcgctttttttcgcgttgcatgaactgacgacggaacctttggagcagacctatgaacgcatagaacagctgcgggaaatacaggccgttctgcaagatattccaccgcagcaacgtgagagatttatcctgcattttgtctacggttactcttactcggagattgccaaaatgcaggggtgtcataaggcggctgtcatgcgttccgctaaatctgcgttgaaaaaatccgtgaaaatctggctgcctgactatcaacttttgcccgttttctctcctaaccacgcggtttttttgttatataaaatatattaccggttactattgcgcaggtctgcgcatctgctgcgctgaacggctgccattaccgaatcatttatttaaaatattccacaccggattcaaaaatctgaatatcctgctcaccataaatattcatggccacaccgcagtcacggcgctcactgtgagccatcttgcccaaaatacgtccgtcagggctggtgataccctcaatagaagcgtaagaaccgtttacattccactcttcatccatagtcacattgccgttcaggtcacaatactgggtagctacctgaccgtttgcaaagagcttccggatccactcttcatttgccacaaagcgtccctcaccgtgagatgcaggatttgcatagacattggccggtacagctttctgcagccatggggatttgttggagaccacttttgtgtaaaccattttggatatgtgacgtccaaccgtgttgtatgtcagagtcggggaatcggctgtctgtccagtgatctctccgtttggtacgagtcccagcttaaccagtgcctggaatccgttgcaaataccaagagcaaggccgtctctttcgttgaccagtctcataaccgcgtctttgatctttgcattctggaacgcggttgcgaagaattttgcggagccgtccggttcgtcacctgctgagaatccgcccgggaacattatgatctgtgcctggtcaatggatttttcaaaggcttcaacagaatcacggatatccgctgcatccaggttcttgaatacttttgtgataacatttgcgccggctctctcaaaagcttttctgctgtcatattcacagttggttcccgggaataccggaataaatacagttggctgtgcaatcttatgcgcgcagatatgaatgctgtctgctttgtacagacctctgtcctcatcctttgtaatgtcatctgtctcggaaccggaacgtgtcttgaataccttctcaagaggtgccttccaggtttccagggcctctgccatggagatactcatatctttatattcgatcgctgccttgtctgtcacttcaccgataaccgtataggtgacagccagctcacctactttgtctgccttcacttcacagataatatcaccgaatcctgcgctgaacagatctctctcatctacattatgctcgatcttaacacccatctggtttccgaatgccattttgctcactgctgacgcgataccgctgcggtcgagtgcatatgcagccacaactctgcctgcctgaatgtcctcatgcagcttgctgtactggtctttcaaagcctcgaagtccggaagatcgtattctgctttgggagcgcgcagccataccagcttgttccccggtgttttcagttccggtgtgataatgtctttttcttttgcaacatccacagcaaaggataccagtgtaggcggcacatcaatttcattgaaggtaccggacatggaatccttaccgccgatagagggaagaccgaatcccatctgtgcggcataggcacccaacagggcagcaaaaggctggctccagcggtggggatcttctgtcattctgcggaaatattcctggaatgtaaaacggatcttgctgtggtcgccgcctgccgcaacgattctggcaacagattccgtcactgcgtagacagcaccgtggtatggactccagcttgacagatacggatcaaatccatagctcatcatagtgactgtctctgttttaccatttaaaacaggaaccttggctaccatagcctgtgtctctgtgagctggtattttccgccataaggcatcaatacgctgcctgctccgatggagctgtcgaacatttccacaaggcctttctgggaacaggtatttaagtcagagagagtatccatccagcgttttttcacgtcagcggattcctctgcccggtccagaacatttccctctctgttgggaacgtctacatatacatctgtctcctgatgggcaccattggtatccaggaatgctctggacagatcaacgatcgtgtttcctctccagttcattacaagacgcggactttccgttaccaccgctaccggaatcgcctccaggttctcctcttttgcgtaatccaggaactgctcaacatctttgggatctaccacaactgccatacgctcctgggattcagagatcgcgatttctgttccatccagaccggcatatttcttcggcaccttgtccagatcgatctgcagtcctgctgccagctcgccgatggcaacagagacaccgccagcaccgaagtcgttacattttttaatgatcctgctgacttcctctcttctgaaaagtctctggatctttctctccgtaggggcattacctttctgtacctcagcaccgcaggtctcaatagattcttctgtgtgcacctttgaggaacctgtagcaccgccgcatccatcacgtccggtacgaccacccagaaggataatgatatcattggggtcagagttctcacggataaccgcgcgtctgggagcagcacctaacacggcaccgatctccatacgttttgccacatagttgggatgatacacttcttttacatatcctgtagccaggccaatctgatttccataggaagaatagccatgagccgcacttctgaccagcttcttctgcggcagttttcccttcatggtatcttttacagacactgtcggatcagccgcgccggtcactcgcattgcctgatatacataggtacgtcctgacagcgggtcacggatagcaccgccaaggcaggtagcagcaccgccgaaaggctcgatctctgtgggatggttatgtgtctcatttttaaagttgatcagccattcctcttccctgccgtccacatcaacagggacaacaatactgcaggcattgatctcatcagactcttcctggtcctcaagctttccttctgcctttaattttttcattgccatcaaagccaggtccataaggcaaacaaacttgtcatccctgtctttgtagatcacctgacggtcagccagatatttttcatacgtttttacaatcggctctttgtaatcgccctcgccaaataccacatttttcagctctgtagagaaagtggtatggcggcagtgatctgaccagtaagtatccagtacgcggatctctgtcatggacgggtcacgtttttcttcatttataaaatagttctggatgtgcaggaaatccttaaaggtcatagccaggttcagggaggaatacagttccttcagctccgactcaggcatctcccggaatccttcaaaaatcttcacatcagcagggtcatcaaagtttgcgaccagtgtctccggcttcgccgcatctgcctctctggaatccacagggttgatacagtgttccttaacagcctcaaactcctcgtcagaaatatttccctcgatcacataggtggttgcagagcggatgataggttcctcatctgcttttaagaactgtatgcactgtaccgcagaatctgctctctggtcaaactgtcccggaaggaattctacggaaaataccctgtccccttccttcttctcaaatgtttcctgatataatacatccaccggaggctcagaaaatacacagttacatgctttctcaaatgcctcatcggaaatattttctacgtcataacgaatcaaaacgcggactcctgccacgtccttaatgcccaaatacgtgctgatctcatgggaaagctcctttgcctgtactgcaaaagccggcttcttctctacatagacacgtcttacactgctcatgttggctcctttctgcctttttcttcggcacaccaaaacccgtactgcggtttttatggatagtgtttggatagtgttgttttgcggcggaggtagtttactccatgggccgctttcgtaactatcataacatggattgcttcattaataaaattaatatatcttatattttttataattaccactaatatataagtacagaaaatatctatacaaacactggatttatgatgccgggtaataaacagtgttttttcctgaaccacgcctttctaacagaccttctcttgtcattctgcttaatatatctcttgctcttctctgttttatatgcaaaagggtctccgtttgggaagaagtaatatatccatttatttttatatgatccattatgatccgatgctgctctttcgcatataatttagataattgctttccggcattactcgaaatctttccactgtgttccggcactgttccggcactctctgatgcgtttccggcattttccggcactgttccggcactctttgatgtgtttccggcatttttctgcaccgttccggcactctctgatacatttccggcactggttgtcagttctaagggattaccatccgttaataattctttccgatacaaattcaccctgaaatctccatcataatccattaattccggctcttccagttcataatttttacattcttgaatcattctgggaattccactgccccagctttctatgattttcatataaacaaatgcactcgctataccacggtttctaatttttgaatatccctctttcatctttttgatagaaacaccacccaaaagcattcccggagacgtcacttccaagcgatcatcatacaaagctacctgtacggcagccggttcaagataacttctgtgacacactgcattacaaataacctctcttatagcttctatcgggaattcatatatatcttgcctataaagtccatctactttggcacccatacgaatatttcgtagaacaaaattgtaagcatcctcaatttgttgctgaatagggcctctatacgttcttctgtctatgaaaatcgctctatttttccccttaaaaaccgcgcattgtatttcagcctgtactgaaggaagggtttttccagctaaaagacagaatccatttgtcggaaatatattaccatctttttcacacaaaagtccccatgacaataattgattcttggttatattgcgaatactgtcactctctgcagcacttctgcacctcatctttgcataatcatatatctcagaacaaagtttttcaatttcctcctctgttactgtctgtccttcagccaaaagctgatcaaaactattatttgttccctctaaaatcaattcctgtatcatataagattctgctggtctggttgttcccgctgatcgaataaatgtacctctctggatacccatagactttacaaaataaggccgttgtctgcctggaaatatttcgaccacaataatagtctttccatcaatttcctgcaaagaaatatcaggtatgatcgttggctcacaactgtcagaaatagcattggttatggcatccatggttttaaacaccatatcgttacttataccaaccacttcacaagtaatatctttaatgccaaaaaccaatttaccgcctttaccatttgcaaaggcaactactgttttcatatatttactacttttatctggcagtgcctctttatattctattgcttttgattctccggccagtatttcttctctagtcatgcacacaccctcttttctaattttcagtaacccactcctttaggtatcccaataattccgaatcatatttttccggcggcagatatcttaactctggaaattcttcaactgctgcaagctgcatttcatctgcaagacttttgtaaatagatacgctctttttctgaagcaaatctcttacttccttcttgtttcctgtcatggcatttttcagaatctccaagtcagtaattgccatgatttcctgttcttccggtatgatcttaaacttttgagccagctcttcaaactgaaaagatcgctctgcagacaataattctgattgtttactggcagttccaaaacttcgcttacactcttcccgaaacgcataggttgctaattgtgaaggcgaaaaacttttcagaggatccccatcgatgccctcctggatcatttctgtccatacttctctcgaaagcttcagtcctttattctccggtacccttgcttcattcaatgtaaacgcccacagacctgcattatcgtattctccgtttctattgatcctccctgcaagctgtaaaaaaacggtacaggaaaacgtacggcaaaacccatttctaaatgatagatttaaccccatactcgcatacgtggtgcagactaacgtccaattttcttttaaagggtctttgttctcatctttgagttttttctccacatcttttaaaatacgtgcgctatcctccggcttgaacacattagataaatgatagactttatgtcctttcattttaagcctgtaagccgccaatgcggaagccttgcgtgtgtccatcatcaatatccttggacctcttttgctcaatgcaaattccaataaactatccagttcattaaaatgattctccgcaaattcttctttagatattccaagataaatcctgtttttttcctgttcctccagtgactttctcaacgaagacggcagcagctcttctggtttctgaatattataacaactggcgcggctacctttatataccttcttaatatttatattatcccaaaaacgtatcatagttccagaagataatataattttacatccccatacatttgacaattctgtgagccattgccatactataggaatacaggtaaccggaaccgatgcgtggaactcatccagaaaaatcccggaaccaggcagttggtgcagttttcttaaccgccctggcttatttgacgcgagagtttcaaagaattgtaccgctgtcgtgagaataatcggtggattccatgtatcagccagcattttcaactcagcagatgaatattcagccctgtgatgtagtacagcaataacgttcttagcagactcccctggtaaaacaactgcctcattcagtaccttctccacctgctccaaaatatttgtataaggcaatattataaatatatgtctcagtcttttcattttggcacagcgaagcagatgggctaaaaatgacgtcgtctttccggttcctactgccgcatctccatcgagcagagaattgtctatatctgttttctctctacatgcataatacatttcatgacgtctgcgattccgctctccattacttaaatctcctgcacattccgcctctttttctttaatatatctgtcaagcgacgccagccgttcctcccatcgcggaaaaatatcctttttcgtctctcctgcagtatcactccaatccgcgtccaccaggcatgacagcataatacgcatttccattgctgtaggtacctctcgctgcacattcagcccgatctttcctcttatctgtctatggatttctagatactcttgaagatgagtctcaatatgattgatcaactcctcttttttcataatacagttttgggggtaatagcaaaatagttcttttgtatccccattcaaatccggaagtccaggcatatgatgcccaaataccaatgccgccgcatatatatctctatactccttatataagtattttgcgccagcaatctgatgcggtattggcaaagcaattttccttttattttcacgtagaacctgttgatcctccttgtccagttttcctacatcatgaaactcaccggccaaaagtaccctctctaatcttgtataaagcacttttggcacataaggctgtatatctttcaacatatcttttataagttttgtcacaccctcggtgtgattctcatatgtctgttctctcccgcagtatgcagcgctgtgagccagtttctccatcagatcatctccattagatcaacagcaggacccgccttaccttccattttcttatttaaatcttcaatacattttttcatttgttccatatcataatcccgtatattatgtgccggtttttctttttcgtaggcatttggagtcagtgcctcaatgatttcaaaatcattaaaacagcccctggctttcctatgttcaacataaaaagcatggcgtatatttacctgtgctctgatataggaagcagtctcctgatatgcatatggcaaaacacggaataggatctgtatatccaaccaggtacactgtgtccgccgtgccatagtggcatttacaaaaaatggcatggcataaagcccatagggaacaatacgatacgccagcggtgccatacctttatccctgccctcctgagccggcagaacctttgttgttgtcagtctctctatttcaatcggggaaagtgaaataccaagtccaaattgaaccacacctgtatgaataaatgtgctattctgctccttgccttcaaggaaagtcgaaccaaatacacgcgcatcccagtatttgtccagaaattcctgcgctgaaagctttttcacttcttttctgtccgttgatttttgttcaagaatatcataatgatcaaactcatcctctgtgattcccagatcactgctgatttcctgccacacaggcccttctttatcactgatcagttcccttattttgtgtttaaaagacactggtgaaatttctccatgtccatcattacggcgtctgggatcgctgtcctgatccggattaccattcggattggaattcactgcttcgatcaacaacatacctgtaccacgatgtaattcattactcattatcatgtacctcctttttttgatctgcttccgactttttttgatctgcttccgattttactgtatttttctccttaaatggaagtgatgccatataaccgaataataataacgtcttttcctgggaagtcggctgctttggcagtattcctcccccgtcttccatgatcgctgaaacagtcttttcaatttctctgaggatccatcttcccctgtcctttttatctgtctccgcccaattaatgtacatagcaattttttcttccagacgtaccattgcttccgttggtgtctgcatagccatctgaagcaccgcatttcccattaactgccctggaagtgaattgttgcgctcactgatacaatattctttatggagcttatctgccagcttcaaaagacggcctaacataaacatagtatccatcatatacttttcctttctgatttccaatttatagagcaaaatacccagcaaagctgctgctgtacatacacgtttcatatattcctctgaaaatggctgttcttccccatatacggtctgaaaatatgcagcatctatcaataaatcctgacttacatataaaaccctttccaatacgttgaagagaaaccccttatcaacggttccctcactagcttccggcagaaaaagataatagatttcctgtaaagtcatggaagaactttttcgcacgatcaattcccccggaacactgccatgcctgctcttataatgaatctgcatcagcctgctgatccccgccggtccgggacaatagggacgataagaatggatttctttcccgtctttattcctgaacttcactttaaatacaaacgccgaaagattttcggccgcttccagccatgtattcatatcttcagacagctgactttggctcattgatctgctataagccatctgtttgcgtcctttatccaaggtctcaaacagctgcagatgcaccagggacgagggagctgagattttcctttcttttaatatgtccaagacatttttacatattttcaaatatttaaaggtagctccatcatcaccaactgcggcagccagttctgcttcattttgcggatcatcttccagccaggccaaaagcagcatgggcgttttttcgttttttccgggaaaactcgtccatgtatatcctctccgggaattgagcatcaaaaataacaacgcatcatttatcttctgcacctgctgctttcccgcagaaaatgcctgaattccttccatgccataatgtaacagacatggatttgctttcgtgttatttgaaaagagatatgcagggccaattacctgaaacttgggatttggatatttctcttcaattggcacaacaggggttcctgaaagtgcagaaataatacagttttcatctttctctttctcaccaatatctctttccgcttccagaaggcaccgcaccaaagcttcttctgtttctaaactagccaccggacagtcaacttgagataattctttaatatcaaaatagcatagacattctgccgtatatttttgttttttagagttgaaccctccaactaacatctttttaacaagatccaattcgcctttatctaattccaatgcttttgatttaagaaaattacgcaaagcctcataaaataattcatttttttcatttggaaatctcatgatcaacttttgtaaagcctcaagatttggatcatcactttccataacaggctttaatttttccttcgtccacggttttatctgaatctcattactcttaggatttttatcatcgtaatccagtccatataatatctggcgcctctcatctaaatctgcggcatcccattttttctcatcaaatgctgcggaaaccgtctccgctaataaagggatttgtatacgtattgcaggaaacctgttatgatttccttttccatgcagccaaagttcacctgtttcattcttatttagcaaacgcatagagaccggaaatccatcactgtccagacgaaaatagagacatggaaatttacccaatttatacatatcacggtgcgtattatcatccgaaagcagccccagcttttccagcgtacaggaaagttgatacagttcattcagcataacagaggaccccctctctgatttgaacattctgaagatattggggtttcaatttcccatccacctgtctgtcgtacatgacatccagcatggaagggatttccaggttaatgcttctatccacaaccgtatccgaacgcaccggaccaaaatatctcggtgtaaattctttcagacccatgcttggcatcctatataaaaccccatttgccagacgccgcataaaaacctcttgtaactgatgcataggattatgaacagatgtgggaggtgaaaacccttttatacacccatatactttataatcaacattttctaggacagtaagcatcagttgaaatggcccgcccgactttcggagtggtccattataattttgtatatatttatgataagaaatcggactgcatatttctactcgttccggccaaaaataagcatccctgctgaacaccacacacccgagcattcctattatcgccgacctggtaggcgccggataagataaaaccgaagacccagaatccggacgcgaaaacaatgcactgggaccagatatttcaaaggaccattcataacgtttctcaaccattttctataacctcctcttacagtcaaattaaaaaagctgatcctcgatgatttatcaatgatcattaagcagcagctcattatgtataaattatattagtctaaaagttttaatgcattgaatattaataaagctttctatttcgccacttatattacctctacatgaacccaatacgataataatctgttttcaaagaacagaataaaatcaaccgaagaataaggctgccgcttaaaaaccatatctaatatggcagcttattttttttaagcactacaacattaataaatttcaatttatatcaagtctctagacttttgtcattttcattttaacacgcacaataaaaatttaaaatatttttcttattaatgttatagagtactgcaatttaagcgaatttattttataatataattgctgtcgactctttccagcaggagggaggtgtcataatgcaatacatagtatcctttctgatttctattttggctggtataatatgctattatatcggcaaatggttagacagaaaataaacctcaacagctagcctgagttattctgccctaaaagaaaaaaagaatccccgaagagctgccactcttcggggattccctttgtgtcataatacacatagtatctttcctactaacaatatactacatcatataaatcaaaatgtcaagtcgacaatttttatcaacaaagcaaataataccctcaaaaaacagaatccttaaaccctcttaaacaaccacctccccaaaaaacaaccacgccatcccccacacccaacaactccatatcctgccgacatccaaaaccaggaagtgtatgggagaggggccggggagccatatgcctgtgagcgatgtacagtggagcgccagggagatccacctgccccagatacttaatgaagaggcctctgccgatgaatttagtatctgggagctggttagctccatggcagcggaacgcttcgctcacaggcatatggctccccggcccctctcccatacacttccgtccgcttccagttttccgtccgcttccagttttccaaaatgtttttccccaatcccattgacttgtcccaccccctttgctaaactcaaataagccatcactattacaaaggagactccacatgaaactaaccgcgaaacacaccatatacagctgctatctcggctacatcacacaggcaatcgtcaacaatctgccgccccttctgttcctcacgttccacaaccagttcggcatctcactggagaagatcagcctgctgatcaccgtgaatttctgcatccagatcctcatagatttcctggcaccgggaatcataaaaaaagtgggataccgggcagtgggaatcacatccttcattgtcaccacccttggtcttacaggctttgcctggcttccttttcttcttcccaacgcctacacaggcatccttatctgtatggcgttcaacgcagtgggcggcggtatcctggaggttatcgtaagccccattgtggagtcctgtcccagtgagaataaggaatctgccatgagccttctccactccttctactgttgggggcacatgggcgtggtaatcctctccaccctgttctttgtggcagcgggcattgattcctggcggtatctcccggctctttgggctttggttccgctgttcacctgtctgatgtttattaaaatccccatttacagcattgagggcgatgacgaggagacgaaaatccccggagggattttcaaaagcggtattttctgggtcctctttctgctgatgatatgtgccggtgcatcggaacaagctgtaagccagtggtcctctctattcgccgaagacggactcggggtcagcaagacagtaggcgaccttctgggtccctgtgcctttgcctttttcatgggactttcacggcttctgtacggaatcaagggcgataagctgaatatccgccacggcctgctgggtaccagtgcgctgtgtatcgttggatatctcatcaccagcctgtcccctataccgcttttatccctggccggctgcgcactttgcggcttctccgtgggtcttatgtggcccggagttttctccctgggcgcagccctctgccggggcggcggcactatgatgtacgctatgtttgcgctggccggtgacgtgggctgttctgccggaccatctgttgtgggattcgtaacggatgcggcaggctccatgaagacaggtatcctggcagccctgattttcccggtgatcttattcctgatcatgctgggactgcagaaaaattccgcaaaagaaaagcatcctgcagacaaaaagacagcagacactgccgaggccagagacttaaggagccaagaataggctcagaatgagaggaattttatggatatcagctttgaactatataaagtattttaccatgtagcttccaccctgagtttttcggaggcttccagacagctctttatctcccagtcagcggtgagccagtccgtaaaatccctggagcagaagcttgggcaccctctctttgtccgcaacacaaaaaaagtagagctgactccagagggagagacccttttccgccacgtgcagccggctgtctctctgcttctccagggtgagaaccagctcatgcacacagcttccgcggaagcgcctctcaggatcggggccagcgacaccatctgccgctattttctcgtgccctatctgcggcgtttccaccaggaattcccggatatccatatcaaagtcaccaatgccacttccattggatgtgtggaactgttggaaaacagacaggtggatttcattgtctgcaattatcccaactcaaggcttcggataaaagaacactacaagacaatcctgaccttccgggatgtctttgccgcaaataagcattattttgactttacggacaggaaactgtccctgactgaactgcaccggtaccccctcctcatgctcagcaaaaagagcactaccagcgagtttctgcacagcctctttctccagaaaggcctgaatctcacacctgaggtggaactgtccagtaatgacctgcttcttgatctggcgtacatcggccttgggatcgcctttgtgccggactttgtcctggagcagagaaaaaaaggactgtaccgccttgaaataaaagaagagctgcccgaaaggcatctggttctggcttacaccgaacagcagagcacctccgcggcagctaataaattcctggaatattttaataatgcctgatttataaaaggcagacctcacaacacagaatcgatcaataattttgtatactcttgtttcggatgaatgatcacctcatccggggtgccttcttccacaattttcccctggtacatcaccagcacatagtcacagaaattctgtacaagcgccagatcatggcagatcagcagaatggaaagccccatttcctccttcagcctttgaagcagtcctattatctgggactgcactgtcacatccagagcgctggtagcttcatcgcagatgagcagacgtggttccacagccagcgctctggctatagctgccctctgacactggcctccgctgacttcatggggatagcgggccgcgtacttttcttccagctccaccatagccagcagttctctcatcttcttttgtgcgtcttttctcttgatcccgtaatttatcattccctccataatcccatcacccagacttcgcctggggtcaaaggaatcctgaggtgtctggaataccatctgcacatttttatacagatctctcaactgtctttttccggctcccatcatctcctgcccatacagaagaatacttcccgagtccggttctgtaaggcgtgtcaccatcctggctgtagtgctttttccgctgccgctctcccccactatacccacgcaggaggcctcccccacagaaaagctcacatcatccacagccgtatatgctttttttgccttataaaatgtctttttcaaattctttacttccagtatttttcccatgcctaacctctgtggatccgcagcacagcactgatcagcctgcgggtatattcttttttgggatggtgcatcacctcttttgtatcaccatattccaccagtctgcccctgtgcatgacagccaccttgtccgccatatattccaccacgccaatattgtgtgtcacaataacaatggttgtgccgaacagttccctcatcttcatcatttcccgcactacctgagcctgaaccgtcacatccagagcgctggtaggctcgtcaccaaagagcagggacggctgcaggatcatggccatcatgatgcccactctctgattcatgccgcctgacagttcaaagggatagcttttcaatattctgtccccgtctgccagcttcattttatcaaacaattccatggcccgctccctgatctcctgtctggatattttctcatgttggagaactgcttcaaaaagctggtcctgtatcgtgcggattggacaaagggatgcccctgtattctggaatatcattcccatctgaggcccccgcagtctgcgcagttcttcccctctaagcgctgtgatatcctggtccttatacaggatacggcctccggtcactgctccgtcactgtccaaaagtcccatggcagctttgatcaaagtgctctttccgctgccgctctcccctacgattcccaggatctgccccggctcaatggtcaggctgacatcttccagaacaggttttcccgtataacacacctgcagatgttccaccgctaaaatcggctgtcccatatctttgatcctttctttctgtgtctcttagtttttatccagattcactgtaatttcataataatcgcagggatgtgcctccaaaccggttactccttttgcggatactattgacattttcagatgtgaggcaaaaataaaggcattgtcatccaaaatagtctgtgtcatctgcaccgccagctttgccctctcatccgtgtcaaaggtagacttcatctctttttccagttcctccagcttgtcactgtgataaccgccgcggttttttgaagattcatccagacagtgtgtggtaaaaaagtattccggatcacctgtgggtgcgcagacaaacgcgcctgcataaatgtcccactccccgctgtccagaaaactctgaaaatcggctgaacaattcacatccaccttgataccgatctcttttaaagtggcctgcacagattccgcaagcagcggaagttcctgccggcttggatatgtgacccagcggatcgtcaggttctctccgtccttgtccacatatccgtccccgtcgctgtccttccagcctgcctcttccaaaagcttctttgctttctcaggttcatatcccggtgccgtaaccatatcatctccaaaagcaaagtttgccgggaaaggtcctgccgccgctgtgccgtttccatccaaaagtgtcttggtgaaattttctttatcaattgacatggcaatggcttctcttaccttttcatcctgaagcgccggagtgtcataattgatctgtccaaagaaggagcgtgaagtttctaccgaagatatggtataggaatctcccgaaaacagcggcagactggcatagggaaggccataggccgcgtcaagctcgccggactgcatagccatggtcatggtatccccatccgaaatggtcttaacatgtatggtatccagctttggctccccatcccaataattttcatttttcactaaagtaaggcctatatctgtctttacctccttggcagtataaggccctgttccggacacattaccgtcctctgtaacgccggcatccatgtctatgatacatccatagggatctgacaggtaattgatcagcgcgggaacgggttcttctgtgactatagtcaaaacctggccatccgccgtagtttccttgatctttagatctccttttgccctctcatgaacacttaccaggtcatccaggcattcctttactgcctgggcgtccagtttgcggccgctggtaaaagtcacattttcccgcagagtgatcttccaggtattttcatccaccagttcatacccttctgcaagccatggttccggttccatttcctttgaatatttaaacagggtctccccaatgccatagcggatacaagcccatccggaatacccattgtgaggatttacatccgattcatcgttctctgcattgaatgtggtatctccgaaattcaatacctttccttctcctgacgcgctgccctttgtctctgtttccgtccctgctttctcttctgtgccgctgccgccgcagccggataaaacacctgcggtcatacagagggccagtaatacagcccccgctttcctgctgaacaatctctttttatacatgactaatctccttttcttttctgttttttatttccgcggggatccataacgtccctcacggtatcgcctaacagattaaataacataactgtgaaaaatattgcaaaacctggggcaaggatcacccagggagacgtctgaagcatacttcttccgctactcatcatagatccccactctgctatagggggaactgctcccagtcccaaaaaggacaggcccgcgatctccatcatcatagtaccgatatccaggacaccggtgataaggatcggtcctgcaatattgggcagcatatgctttccgatgatcttccacgttttgcagcctgacaaccgggctgccgcgataaaaggcgcttctttcagggtcatcacctggcttctggcgatcctggcaaatttcggccaggatatacatgccagcgcagccactgcattgataacacctcccccggtaacccctgccaccgcaatagcaaaaaccattcccggaaatgccagaaagatatcggagatcctcatgagcacagtgtccgtttttcctcccttatatccgcaaaatacccctataacagttcccactgccataatgatgagcaccagtgccagagaggaaaagattgttgtctgtcctcccatgatcacccgggaaagcatatctcttccgtatcggtctgtccccaataggtgcgcccctcccggcggctgaagcgcatgttccaaatcctgtgcataaggatcatagggcacaatgtattgggcaaaaactgcggccaaaagcagaagtcccactaatacagccaaaataatacatttcagttttgtatggtctctcttcctcatccggcttcctcctgtcccatgcgaatccttgggtccagacagcagtaaatgatatctgtaacaagattcaccagcacataaatgacagccatccagatgacatacgcctggatcaccggataatcacgcatagttatggcatcgacagccattttccctacaccgtcccacataaatatggactcgacaatggctgtccctcccagcagggaaccgatggataacgccagaagtgtgacgatggtcagcatagatgctttcagcacactgaaatataatattttattttcctgtaccccccgtgcccttgccccctgtacatactctttattcagctcctccagaactgcggcacgcacctgtctggtgtattttgccgccattgcaagagccagggtaagcgttggcaggataatactcttccatccctgggtgtttcccataaccggaaaccagccaagcttcagggcgaaaaaatagatcagcagcaaagacacaaaaaagttcggaagggaatttcctataaaactgaaaaagcgtatcagataatcccaaaagctgttctgctttacagccgataggattccaaaaggaatcgagatcaatacagtcagcaaaacagatgtgacggccagcgccatcgtggccggaagctttgatacaaaagttgtaaatacaggctgtcccgatacaaaggatttccccatatcacctgtgagcacacctttcagccacaccacatactgctcgggaagaggcttatccagtcccagttcttccctcgccgcagctttctcagcctcagacatagacccccctgtattctgttccattacatcaatggcatccatggaagacgtctgcattaaaataaaggacagcaaagtgatccctatcaggatcggaataagctgcagaagcctttttattatgtactttctcatcctctcatcccttgtccactctttcccgcgcatatcataaacataggcgtggggttatagaattcatccttctctctatagatccgcctgctgatccccaaatctatggaaaactcctccattcccatctgccccagcgtctccacatcccaggccgggcggacacgggaactgatgggaagctggcgcttgatctcctcacactcctgcatcatttcattcccgagggtgtgatgtgcatggctttttggcagttctgatgtgtctgcaaaattactggcaccataattggcatcaaaattcaaaaggattccctccgccttcaatacccttttccactccgcgtaagcctcctttacatggggcagcgtccaggtcagattcctggagataacaacatcaaagctgttatcttcaaattccagcttctccgcatccatgaccagaaaacggcaggagaccttttcttcctctgcaagctgtttggaattgacgatcatctccggggtcagatctgtccctgtcacttcgtgcccctgttttgccaaaagaatggaaaagaaacctgagccgcatcccacgtccagaatttttaatttcttaccttttggaagcctctggcaaatttcctgcagccagcgctctgcgagagggcttttcagttctctccgcctctgctccataaagctctcgctgcgctttgcccagtattctgtgatcctctcttttctgtcatcaaagttcttgacgattcttccgtaagcaatcatagggccgttttccagaacctgcagactgcctgtctgacacaggataacaccgtcgcattccgcacggcagacctccatcacattcccctcatagtcctttacaatacccagaacctccccgccctggatcatatctcccggcgtcttatagggataccagcagccagtggcagacgcggcttgatatctgatatccaccacgtcaagaggatagtagacacggtagtctctctgcccatcataaatacccagtgaacataaaatgttccgcacatcccttctggtggaacggacctcctccatggtccagccgcccatgccgcctctctctatgaggataccgggaatccccgtatgtgccgcataattataagctccgcctgtggcaaccgtggaccgaaccatatagggcacatccacctgctctgccatctttcttgacattgccacaacagattcctctgccctccccgcataatacacataaggggtgagctgttcgtaatcgtcgccgctgtgcaggtcaatgcagaaatcagccgcaggaaacaattcttttgtgatcgcccatgcaagctgctgtgtggccgtcccttccggatctccgggaaattcccggttcaggttcttcttatcctccacgcccaaacttccgcctctgcactcaaaggcatccctgcatatgacttttacaaggatgatccttccgttgatcttctctgtttttagtttttccgaaagttcaatggctgcctggatgcccacatattctcctgcgtgaactcctgacatgatgagaaccgtcttacccggtttctcaccgtttaggatggtcacaggcagcttgaatcttccctctgccagttccagaaaaccactgcatctctcccccggctctgcctttatatttcccagaataaatgtttccttattaagcatagactttgctgtcccctttctgcgcgttgatcataaacataggtgttgatccgtaattcagtttttcttccctgctccataccctgtcccacactcccgtatctgtgcgtacctttgcaaatcctgtgtttttcaatatctccctatcccattcaggacgcatcctggcggagaggggcatctgaagggcgatctgctccatagcatcaatatctgtgcacaggtaatggtcatccaggcttaactgctccacatttttcctatcctgttcataggcctcccgctttttctcatcatagagatatccgtaccagttggcgtcaaaattcagaagctttccgcccggcttcagcacccggtgccattctttataggcctgttccggcttttccaggttccaggtcaggtttctggagatcaccacatcaaatgtgttgtcctcaaactccagatcctgggcatccatccggtaaaaatttattttttcacacagacttcccgcattttccatagccttctccagcatttcacgggtgtaatccacggctgtaaccatatatcctgcccctgccagaataatggggaaaaatcccgggccggtgccaatgtccagtatttttatctcttctttgggcagccttggaaattctccctccagcaattccagccaggcctccttttgatttccctccagttccttgtggttcacttccgaatatccttctgtgcgcgtgctccagtatctctctattttctccaataacatttctatagttccatccttttcgctaatatatttctattttcgtaactgttcgatcctatcacagccactgttttcctacttttctactttaccaaaacaaaaaaaatgccacaagccccgtgggggggattatggcattcttccagacaaaaaaatattatcctattgttttattttgcgccccgtatctctgcggacacggtatgcacagcaaatctgcttaaatctcagcgattgcctccacttcacacagtacattcttaggcagtgtctttactgctacgcaggaacgtgccggtttgcctgtgaaatattttccatatacctcattaaatgctgcaaagttgcccatatctgacagaaaacaggttgtcttaactgttttctcatagctgcttcccgcctctttgagcacctcgcccagattcttcatcacctgttctgcctgctcctcaatggtcaccgctgtaatttcgcctgtggccgggtcaatggggatctgaccggaagtgaataccactccgtttaaaatcattgcctgtgaatatggtccgatcgctgccggagccttgtcagtgcttactaccttcataaaaatatctcccttctgaaatacaaatcctcccccttttccaaaatcacatctgtccatacacactctgacagttatgaacagacatccgtattggttattcaggggaatgtatatattatacgtttctaaaagggaacggtcaagctaaagtagcgcactttcctctgtatgcccccagaatccattccctatatatccctcggggagcggctccggaaccgtaaataccgttttcatgttatatgtgtttcccgtctccaggctctctgtcattccctgtgctgcctccagtacatggagcgccatctctttgcccgctctgtggggccgtcctttccgaatagcccaggccatctccgctgcccccagcccccgggattgttcccggtatccgtgtgtatagggaaggacagccggcgggttccctgttttttgaagggttgtttttccctcaaaggtattgggatcgcccagcgtcagaatccctttactgccgcacagctctaaatgaaaggtctcctccgctatacatgccccatttaaatggaaggtgaccagtgtcccacaggcaaattccagcagggctgtgagtacgttacagtcctccacagtaaactctttttcaaagagcggccctcccactctgtttccgtgcctcacaggatttctttttttttccaaaggcgctgatccgttcaatgggtccaaggatactgcacagggctgtcaggtaataacaacccatatcatacaggatagatccgcctttccgattcagatgcggaaggatttctcccaacagtctgtaatccctggtgagggacacaataccgcttatgatctcccctgccagtccccggcggactgcatcggcagcagtctgaagccctccgcccaaaaatgtgtccggcgctgcgcccaggcgtacctgatgcagatctgcctgacggcagagttccagtccctcctcaaaagtgactgccagcattttttccgaaaatacatgctttcccgcctctattgcctgaagtgtgagagtatagtggaccgacggatttgtcaggttcaccaccagttctatgctgctgtcttccaggatttcctgccactgcataggacggatgccgtatttttttgccgtgtgctccatcttttcccggtctatatctgagcaggctgtaagttctatgacgcagaatttctcctgaaacgcctgaaggtatacctcgctgataaccccgcagcccactaccgcagttctcactctttccatcctgacaccttctttgcatagacaagtcctgcctccggcgcatcctccgggaaatattccagtcccatatatccctcatacgcttcgttctctattgcctggaaaacataagggtaattgatctccgactgatacaactcatgccgtcccggattgcctgccgcatgaaaatggcctatgcagggaaggtacttccgtatcctgcggatcagatcgccttctgtgatctgctgatggtagatgtcaaacagcattttcacattcggactgcccacttcctttaggatctctgccgcctcatccgagccggaaaggaagtacccctgatgatccactctcagattcagcggctccaccaccaaggtgaccccctttttttccagaataggcgcgcaggctttcagtccttctatcagagattttttctgtatttcccggtcctttcctgtatctgccccggtctgtgtgatcaggcatcggcagtttaaacgctctgctatttccagcgtttcctccagtcccttcacataatccccccgaagcagcgggtctgtgaggctgataaacttagtacaaaaggcagcaacccggaatcccttttccttctgatatttggcaagcttctgtatatccttatcctcccagccccaaaattcaatggtatccagcccatttgccatcacatcgtcaatggcggccgtgatgtctttccctgcatagactgcgtctatacacacagaaattttcaaatttttttcctccttttatcagtacgtaaacataacctgtatcacttgtccgggatctttgtcaataaccttgtacgcatgggctatgtcttcatatggaaatctgtccatgagattatctgttttcaaatgtctcaaaatctctatacaggcctccactctccgcccataattccacagattggaaaaggaagggtccacagcccctgtctgtgactgctttatgcctatcctgttatgatggaattcctccgacagattcacatccgccagcgctccctggtaccaggccagtgctgtcactgtggtatccggcgccgcaatgcgtatggcctcattgagggcttttgcgttaccggaggcttctatcaccttgtctgcccctcggttacctgtaagcctgcgtatctccagagccacatcctgttccgatgggtcaaagacccggtcacagccgttctccagagcagccgctcttctcttttctatcatatcgattccatacaccttgtgcgcaccgctcatacgggccatctgtaccaggagctgccccagtacgcccagaccgctgatcaccacaacatcccccagatttatatgggtatccatgattccattatacgccgtgatcaggttggtgagcaagatgcctttttccggcgggatatcttttggaagtacaaccgcatcctctgcgttgatcacattctcctcctggtggggcgcactgcaagccacaatgtctccccctttgattcccttcaccgcttttcctgtctcgaccacctccccaacggaggcatatcccatataccatacaccggggtcaaagcttctgatgggatattcccaggtctcatcctcccctgccgctaaaaacaggcgggtatccggatcctgctttttcctaaaaaacggggcaagccctctgtatacattcatctctgtcccatggctgacgccggagcataaggattttaatctgatctgatcctccttcataggcagctttggcatttcaatcacctttagctgtcttggtccctcatacatgatcgctttcataatttttagtcctttcttttttctcttgtccgcagccgggcagacacccgaagtcctcccggctgcttccctgcggggtcaatatccgatttcctgcaggcctttcatacacttctcaatggcactttcaatatctgtgccgttgacaacttctgaacacattttcggaataggtccgtccggccatgcatccaactggctccaggttgtgagaggcatatcacctgcctgggagcgttttgaagtctccacataggcattcagccatgcatcctctgtaaaataggaatccttcataacatttacattagaattaagaagggaaagctgcttgctcaggtagagctgaacctcctcgctgcaaaaatatttcacccattccttggccgcatccgggtattgtgtggtcttaaaaactgcaatgggcgcggagaaggcaatggcatggttctcattttccgcccctgttgcagtggggagcggggctgcggcaaacttaccctccatctggggtgcagaacttaaaatggatgtcctgttgtctgctgcaccgccgaacaccatagacacattaccccccatgaattccgtcagggcatcataggatgcatccacactgctgttgcagatcttgtatttattgatacagtctgataaaaactgaagggatttcttaccctcttcgctgttgaaggtaaactcggaaaagtcatcactcatcatcttcccgccgctctgggccagcatggaaaaccaggactggtcatatcggcccatatctgaataccaggcaaggcctgcatgggtaatgtttccgctgtcatctgtctcggtgagcttttcggcggtctcgatcaattcatcccaggtctccggggcttttgtgatccctgctttttcaaagtcttctgtgttgtagatcagcgcacgtgtgtcaaatctccacggaacgccataccagtctccatccacacaggcctcatcttttcctgctgagtaccaggtatcctccccgcccagctcttggatcacatcattgatctccataagtccataatcatcagaactcatctccacaaaagagtttgtgaaaaatacatctcccacatcaggcgattccccgccggtacaggccagtgtcagtttctgattggcactgccccagtcgttgatcacatagttcacctggatccctgtcttttcaaggaaatctgaggtcaccttgtccatggcttccgtctggttggaggggtcattgccataactctgcatccagaaggtaagctctgtgccgtcatatggtttttcttttgccgcgctgccttcctctgccgcggcattaccatccgtctcctctttctttgtctctgccgtctcctgggcagcctcctttccgcatgcagacagcatccccgctgtcatcactgctgtcaggccaagcgccagccatttcttttctctcatacttttttcctccttgttttttttattgttaacccttgaccgctcctgcagcaagtccgctgatcaaatatttctgcagaaacgcaaagattattaccgccggcagtgttataaaaatccccgccgtcatggtgagtgccagctttgtatttgccccgtactgtcctataaaatcatagactcccactgacacaggtttcagtttattattagataaaaggatgctcgcccacatatattcgttccacgccagtataaacgcaaaaatcgcagtggaaatgatccccggcacagaaatcggcagacagatcctgaaaaatgtcccaaactggctgcagccgtccacacgcgcgctctcctcgatctctcttggaatggcagcgtcaaaatatcctttgatcatcagggtacaaaagggaaccgcccagacggtataggcaatgataagccctctatatgtattggtcatccccatgttaaacataatgaaatataagcttatcatggtcacgatccccggtatcaattgtgtgcagagcatcagcacaagggagattttctgtgcccttctcctgatatatctgctgatgctgtatccgcacagagtggcaaaaaccacgctcaccgctgtgactgccacggacacaacaaaagaattcctcatataagatcccaacggaatggactgccagactctggagaaattgtccagagagatcctggagggcagaagcgttgccggggaaaccataacctcctccgtgggcttcaccgctgtcaccaccatccagtaatatggaagcagaacaaacgcgctgataatgatcaatgacaggtaatgccgaattatctcacctgttttctttaccttcttcctcattttcttctccccctgccgtcagcttatttctttcagagatgaacggatatagacaactgccggaaccagggcaatgcacatcatgatcacactgaccgctgacgcatatccgtatctgaaatttgtaaatgcctgctggtatacttccacagccagcagcttagtcagccccaaaggcccgccctgtgtcaccatataactgatattaaagttattaaactgccagatcagctccaacagcacagacacggatatgaccggcctgatacatgggaccgtgatcttccaaaagctttttatctttcccgccccgtccatagtggcggcctcatacagctccttaggcacagtctgcagtccggcaataaacatcaccatgaggaagggaaaaatagaccacacatttatgagcgtgatcataatgagcggcaccgagagaaaaccgaaatacgtctgtgtactctccagaaagctcaccggcaccttcacaattcccagcttcagcaaaatagagttcagagggctgaagtttgcactcagtatggtcctccacacaaaggaggccaccagaggaggcgtcacccaggggatcagaaacatcgcccggaaaaagccgcgtccgggatacggcttgatcaacttcacggcaatgaacatagcaagtgccacccccaggatcaaagacactgctgcaaaaaacaatgtattgaagatcacctgccaggtatccggatttttaagagccgtcccgtaattggacagtcctataaaagataccgtttttttcaaaagctgtttgtcaaaaaaagacatccacatagtctttattgtgggatataccgataccagcaaaacagccgctgctgcgggaagcagcatgagaagcggcgtatgtttatccagtttctccaccccgtttttcttatctttccttcctttttcagtcatcgtacccttccttctccaatatccgccctcattgcctgttcaggtctctgacggaattccgttccacgtatactggtccaatctttactgttctgttcccgctgtttcctcccggcttctccagttttgtgatcaatgccaccacagccgcctccgcgatttcccggaccggcagccgcatggtggacagcggcggtgaaagaaacttggcaatggtatcatcatatccgatcacagagatatcttcgggaacttttatatttctctcatacaatgcgcgcagcacccctgccgccagaatatccgatgatgcgaaaatggcagtgggcatgtcccccttcatctcctccaggatctccatgcacttcatgaatccatgttccacggtatactcctgcgtaaaataagaatgcctctgcacatatgtatcatccactccgcgcattgcctgcacatatccgtgatagcgttcctgctccacaggctcctctgactctctttccaaatatacgatcttcctgtgccctgctgccagcagcttctccgtggcaatataactgccctctgtgttgtccaccagcaccttttccacctcatacacatctgcaggccgttcgatcatcaccatgggaatggtcagtccctttaccttctctcccaattcctttacaatcttcccgttgatgcccgggttcagaatgatcccatccacccggtaggccagcagatccctcagttggttctccaccatctccatattgccctcttcaaaggcaatggaaattgtcttataccctctggaaaaactttctcgctcaatggttgcagctatctttgtaaagaaaatattctcctctgaagtcacatgaatatgaccgatcaatttcgaacatccgtcccgcagacactttgcctgctggtttgggatgtaatgcagcctgtccatcacctcactgatcctccgccttttttcctccgccacatacccgctattattcacacaccttgccacacaggaaacagacacagaggcctcttcggcaatccttttcattgtgatttttttcacattttcatcctttttatatgaaattttttcacattccatattttcaagcatttctttaaatttcacctcttttcacaacttttgtatactttctacacttttttctgttttctatcttatatttcgtattatataaccatagttttacagatttcaacccttaaaattattttcgttaatagttaccagatttcaaatatgtggcaaccttgccacattatgcacattgtacacggaaatcatatcgttattattttcacataattccacaattttccaccctccccgccacaaaaaaataccccacagagacagccatcaatcaccgtccccacagggcatcacaccatccaatttttaattttctgcattcctaaatacttttttccatctttttttcttttctccccatacccttcccaaatcctatacctcccgccccgccagccccagggaaatccagggtgccgggggaggcaggggacgtgtgttgagatgaacgaggttaagcgaagcggtagtcagatccacctgccccggctgattaatgaggaagccattgctgacgaatttagcagccgggagcaggttagctgaatgccggcggagcgtcgagagaatctcaacacacgtcccctgcctcccccggcgccctggatttcccgtccccatacacatccccccaaaactcctccactctccctctctcatcctccagtgaacagatctcataccctccccactccaccggaaacagttctctgtaagccctctgcagaaaccgctcatccaaaagcagaacaatccctctgtcttcttttgtcctgatcacccttcccgcagactgcagcaccttattcattcccggataccgataggcatactcgaatcccgccctatttttctcatcataataattctttaatatttccctctcataccccacctggggcagtcctgtccctactaaaatggccccgatcaacttctccccggtcagatcgatcccctcagaaaaaatgcctcccatcacacaaaatcccacaagcgttccgtcctgatccccctcaaaccgttccagaaattcttccttctccccttccgtcatattcccggactgcagcacagactgcagacccatcccggaactcttctcctcaaaaatctcatacacatcctgcagcatcttataagaggggaaaaacaccatataatttccctttttcactgtaactgtctgcagaatatactgagccagctttccatattcctcctgtccccgtctcgtatacttactgctcacatctctagcgatcataagcttcaggttctcccggggaaaaggcgatttggcacagatagcataatcatcttcccttgtgctgaacaacgacctgtaataccccataggcagcagtgtggcggaaaaaaacacagtgcctctgcccttgttcaggcattcctgcagattcacttttggatttacacagaacagcgtcagatagaatctcccctctgccccatggtacgtatagatcacatagttttcatccagcaggtcatacatattcaaaaaatgccgcacctcaaaggaaaattccagcactgcactgcgcactttctcctcctgctccctctccaggaaattttccatctcccccagaagattcataagctgcagtgccagagcgcctatattttccatcactctgtactcatcctggcattccctcttatattccagcaaaaccttattacacttttccaggatcctctccagctttctgctgtgctctttcacaactttcttcacttccagaaaatcctctttacagagaaccgcgctgtacatattccgccctctgtccaccaggttatgggcctcatcaatgagaaacagataatcccccttcacaccatctccgaaaaaacgtttcagatacacattgggatcaaacacataattataatcgcagatcaccgcatccacccaggtagaggtatccagacacatttcaaagggacacacctgccatttttctgcctgttcaagcagcacttctctctgataagtatcctgctcagtcagcagttcgtataccgcatcattcaccctgtcaaaatgtccctttgcatagggacacttctccggattacactccacctcatccatcaaacacattttctccttggaagtgatggtaagcgtcttatacgacagtccttttccttttaaaattgaaaatgcctcctccgctaccgtcctggtgatcgtcttggctgtcagatagaaaatcttatccccatagccttcccccacggctctcacagcgggaaaaagagccgccatagtctttccgatcccggtgggtgcctgaataaacaactgtttcccgctcctgaatgtgtggtagaccccagccgtcagattcttctgcccttcccggtactcatagggaaactccagcccctgcatggactccctgcgttctattcttctcctgtactggaaataagcccacttataatattgttccatcagatccgagaaccactttttgagcacagacatagacatttcttcccggaaacgctttacctgctcagattccaactggcagtaagtcatctgcacccctatctgctccagtcccttctgggttccgtaaatataagcataacacatagcctgtgccctatgaaccggcacaggctcttccaaaaattcaagatcccggtagacacctttgatctcatcaatggtaactccatccttctcctctatgatcccatccgctctgccttccagccggacaacaaattcatcgaattcttcctcccacaaaagcggaacctccgcccgataagacaatcccatctgcttctggatcttccggtgcgccttactccccttcctcatagcctcccggtccgcagacactgtcctccggttatccaaattcccgctgcgcaggataaactccaccaaattcctaaccgatatccgaataacttctttcatctcactcatacccatattctaacacagaacctatgttcctgtacatccccaaccccatcccacacccttttccttccatagacacatttatctttatactgcattcctttctcctcacagccaattttcccattctgaccacatctcttttggtaatacagacactttcccattctgacccatctatcttttgccacacagacactttcccattctgaccacatctctctttttgccacagacattttcccattctgaccacatctcttttggtaacacagacattttctcattcttaccacatctttttggtaacacagactctttcccattctgacccaatcttattctcccacagcccatttccttggcttatatcacatctttttctgttccacagccaaccccaggggaagcatggcggatacgggaggaggaggggattgcctgtggacagtgtttcgcggagcggtgaccagatccacctgccccagacacttagtgaagagcgctctcgcgatgaacttagttactgggagcaggttagctgggcgccagtggagtgcatcgtccacaggcaatcccctcctcctcccgtatccgtcatgcttccccgtcctcttattcccacccgcatccgccatgcttccccgtccgcttatttctccccacaaaaaaagagcagaagcccacatccgtgtctcctgccctaaaattaacatatcatttatcagtttccgagaaatccccctctaaggaattgcaaatctgtccagaaatctgtcgaatttctcatcatgcccattacatcttaccgtgagcacgcgtgtcaaatccatacttaaaactccaaggattgacttcgcatcaatgatgactctgttgtaaaaaacatcgatatcaaattcgtatttactggcctcattgacaaactccttaacgtcgcctgtctcattcagcttaatctggcgttgtaccatatttaccatcctttctttaagaaacaacacgccaactgatattttagttatgtcttgattctttattgttaggacgtattatgacagctatgcctatatttgtcaagaatttgacaagattttcctacttgtaccaaaaaccgtcattttatcgcgttttttagcaaaatgaacaggaaatattttgtcgaatcttgtctgttctgtgcagtttgacgtctcagtttatccatgatataccagatatcattttactcagagaaatattcccaaatcagagactcaaattttgtcactgtatcagccgtccgctcaggctttcggcagatatttcatggaacctttcagatattcattgatcacatccgcataaccgccggcatctacgatggcagccagttcaggttccagcggcatcttggcaataaccggaacacccagctccgctccgatggcatctactttgctctctccgaacacataaatttttttgccgcagtccggacatttcacaaagctgtagttttccaccagaccgacaaccggcacattcatcattttggccatgttgtaagcctttctcacgatcatgtgcaccaagtcctgtggagatgacacgatgacgataccgtccaccggcagagactggaatacagtcagcggaacgtctcctgttcccggaggcatgtccacaaacagataatccagttcaccccatattacatctgtccagaattgttttaccatatttgcaagaatcgggcctctccagataaccggtgcctcttcctggggcaaaagcagattgatggacatgattttaatatcattctttgtcaggatcggatatatgccgttgtcatcggctgtagcggaacctttgattccgtacattctcggaatagatggtcctgtgatatctgcatccagaatacctacgcgatatcccttggatgccatctcattggccagtgacgcagtgacaaaagatttgcccacgccgccttttccgctgacaaccccgataactttcttaatatcagagaatgcattcaactcttcttttgggattccgccgccttttgcatggctgcatccctcacaactttttttatcacagctcttgctgtcgcattgtttcttttcttcactcatgattctttcctttcccacagaggtttataccttatttcataaacctgtcaatggctttatttaattcttccagggcttctttatccccgctctccactgcatccacgatacagtgctcaatatgatcctgcaggatcacctttcccgtattattgatcgccgccttcactgccgaaagctgtatcagcacctcactgcaatctctgccgtcctccaccatgcggcggatggattccagatgaccgatggctctggacaatcggttcagcaccgcttttgtatgggtgtgggtgtgtgtatgggaatgggagtgcccatgtccctctgcgccggcatcttcatgcacatgctcaatcaccgttccgtcaggaagactgtgtgtatggacatgttttgtctcttccattgtggtttcctcctcgcgctttctctattatatcaaacccagaaaaaaaagcaatggtttaccagcccgcgcagcacagatatagaatatctgtaacgttttgcaccggcaagtctggggatttccatgcttcctgcatgaaaagccgtgtaaaagcaacgtctaaatctccgaaaatgtaaatctctggtgtacatccgctgtcatcacatcatataccacgcttccgtcttccttctctgtcttctccatacgaagctccttctcggacctaaactttgcgttaagccatatttccggactctccatatcaatttcctgaataaaattatctctggaatggtttcccggacactggttaaatatttcatgtatcacttcatacgttttcatatcttcgcttcctttcaaattctgtaatttcaccgttacaaacaactatccatacaggaccttctacggcaaaaaaacgctgccaatcgttttctcaattatgccgccggtcaaagggcatccttttatttttccctcaactctttggcatatgcaatataataatgccgtccattagcactggtctcatattctgctgtcatttccaatgcagcggcctttaactgaaagacctctttaccggctgatgcttcatctgccagaagtatatcacataattccaggcaccactgatagtccttttcacggacagcactttttgctgcatccaaaacagcctgtgtgccgcccatcaaagctatcatcttttgagaacgttttttcggaggcattggatgcaggttggtggaatttccgtcaaaccaccccagatatgccgtataaatagcccgcacagtccattccaaacagccataatgctctgacaaatatggcagatccgcatattcaggcggcaattggatttccgatgccaactgatctggacctttgcccgaattcatcccctcctgctgacagatcccggtattgtccgccccgtattgcataaagattcgggaaacagccatagtaattatctccacagcataatacttccttctgtggaaaccatatcatgatctgatcctccgcctcgccgggaagacggaccatttctacctgtacaccatctatttcacggatcatctgctcctgatcatacacggtattgggcgggatgaatgctcggtgttccccatgcgttatcccctctctcggtccaatcccctgtgaaatagcctcctcatccgataacgtgtagccgaactgccttgcacctcgcagactctggatatcctgtaaaagctcagttttctctaaaacagggtttttaggcttaaaagctataatctccggaccgcattccacaaaagcccctgcgccgccccggtggtccggatggctgtgggtatatataatggttcccacttctttgtttgtacactcccttatgatcttcagcagcttttcgccccgttcccgcgtgtccagtgtatcgatcaaaataacgctggtctcagcctccgcaaaaactgcattgctgtggcccagccctgacacaaaccacacacctttcgtcacttccgtaatcgtttccttataattcttttccgtaaaatcctgcagccgttgatttccattttctatcagcatggtttctattcctttcccgggtgtatctcaaacctcattctgacaagctctgatttatttgttccactatccctgcaacgatttttgctgatatcccagatgccgcttcacagttcttatcaaaattctctatccctttgtgtgtgacagtatctgtaatcgtcctgactgccaaaaacggaatcttatttacatagcagacatgggcaacactggctgtttccatgtcaacagagagaggggcatattttctattgatctcctctcttttttcatcttctatgaattgctctcctgtcaccatcgttccgaaacggacagggtatttggctgtacggctgtattttttagccatggctgataaattctcatctgccgcgaaataattattttttaaccatgggtgaaactccgtcaggatgtcatccgccacatcatggtaaatcacacgttccgatatgaccgtatcgaaaagctgtacactttcctccattcccccggcagttcccccattgatgatacagtctacgtgatagacatcaatcagtaactgagctgcaacagcggcatttactttacagactccactgtatactgccaccacgtccacctgcttcatggtcccttcataaaatttaagcatggccttttctgttgttttataattccggatataatttaaaaaaggcgccagttccgtatcgctggcacataggattcctatttttttcatcacttatttacctcgccttctattttatcacaatcgtacagattttgtgtcattttctcccctgtttttacaaaaaaaccaaaaataaattgcaaagcccgtataaatatcgtattatggtagttaccagaaaaaccggggtatctgacacccggatacgtaaaaccagggaggaattcaaatgcagcttttaaaagagcgtattcttaaagacggcacggtaaagccgggtaatatactgaaggtggacagtttcctgaaccaccagatggacataccattcatcaacgagattggcaaagagttcaaacgcagatttgccgactcccctatcacaaaaattctgacaattgaggcctcaggcatcggtattgcctgtatcgtggcacagtatttcggcgtcccggtggtttttgcaaaaaaagcccagagcctgaacctggacggagagatgtatacaactaaagtccagtcttttacccataaaaaagtttacgatgtgatcttatcaaaaaaattcctgcagccggatgaccatgtactcatcattgacgatttcctggccaacggatgcgcactccagggattgatcgagattgtagagacagccggcgcaaccctggaaggagccggtattgtcattgaaaaaggctttcagcacggcggcgacgcgctgagagaaaagggaatccgtgtggagtccctggctattgtggattccatgagcgaccattctctcaccttccgcgcatagtattgtatcgggcagtccaaaactggactgctcttttttttataaaactggctctttatagaatgccaattttcggctatattgtgtagaaagaacgtgtttggcagccaggcagaattccgtcacccaaagcggttccgcatggattttgcttgtaactgtaaaatacggaacaattggtctatttaaaggagttgttatcatggaaaacaaaacgaaaaagattgtcatgaccgcacttttcgcggctctggcctgtgttgccactatgtccatccgcattcccacacccggaacaggcggttacatccacccgggagatgccgttgtaattctgtccggaatcattcttggccctgtctacggattcctggctgccggtattggttcctgtatggctgacctgctgggcggatattttatctatgtccccatcaccttcgccataaaaggcctggttgccctattggctgcctttgcctacaaaaaaatagcaaaagacagtaaaacagcctgggcaggtgttctggccggcggcatcatcgacatgatactggttgcggggggatactgcctgtgtgaattcttcctgtatggcacagccgcatttttaagcgtaccgtccaatctgatccagggtgccagcggactgatcatctcactggtcctctatccgcttctcactgcagtgccggatatcaaacggatgatcgcctccgcgtaagtgtctgcccggcttattttcagcagcactgtgtgatagaatcaaggatgcgttttagattttacagttcccggcagacggcactgtatcatcaaaacgcatccttttattatctacaaacctttattttctacaagtctttgatcatctggaaataatgcagttcctcataccccagccgctcatacagggcaatagctctcttattgctataggtagcctccagacggaatctctttgcatgagaatattcctgctccagccatgcaaagacttcactgccgtatccctttcctcgggcactttccataaaatacagttcctccagccataccgtcagacctcccgcctcattgctgaacgtaaaggcaagaagcagataccccttcacgccgctttcatcctccagcatcagcactctggcgcgttctttgctccgcagacactcctggagtgtagcctcaaaatgctcctgcggcactgtatgaatgcaggcttcaccgccgtaaaactctttctccatcttaaagaatatgtctctgtcttcctctctgatatctctgatcgtcaacataaatattgttatccagtaactgtccttcaacccacagttacgttatcctttctcttatttttctgtttctgtcattgcaaaaactttattcatcatttcacagttcttactgtggggacattcaccgtaatcacagtcgaccctgtcaaaatgcaggccattttcatcctgtatgaattcacatatggcacttctagccatatcataattcttgcagtatccattcacaaattcttctactatctcactcatcctgcttgtccttcccttccgtttctttttgcttccagttttgggaaagcccctccgcagcactcacctcaggagccggaagttttccctcgggatggcctcccgccatattttcaatgggctgtttcaggaaggaggcacgcatgatggcccctgttccgaattttttacggatctcatctacagcctggtccattttctccagtttatcataatccgtatgatcaaacaaggacaactgccggccgctctcctcccctgatacacggctggtccggacccccagaaggcggataggcgctccatcccacagttcatcaaacagcctgcaggaatggaaataaagttcggaggtgatatttgtcggcgctttcagcacggtctggtgagagactgactgcaattcacagtccttgatggtgactgagaccacttccgctttcattccgtcactgcgcagcctggaggccaccgtctcacacagggaaagcagcacctgctttgcagtctcttcatccaccacattaaaagctatggttgtgctgttgccatatcctttattatcctcctgcactgcctccaccactgcgctgtccctgccgttggcagaattccagatggcctccccatgctttttcagatgatgcttcaaaatttccacatctgcggcagccagatccccgatggtatagattcccagctttttcagggtgttttccgtggatctacctacaaacagcagttccgataccggcaggggccacatcttttcaggaatttcttccggaaacagggtgtgcactctgtccggtttctgaaaatcagatgccatctttgccaacagcttattgctggagattcctatatttaccgtaaatcccagctccgttctgatacggtccttgagcttatgagcaaatgccacgggttcccccaaaagccgctccatccctgtcatattcataaatgcttcgtctatgctgtatttttccacttccggcgtgtattctctcaggatatccataaacttttttgaaaattccttatacattccatggtgtgatgggataatcgtcagggagggacatttccgcatggcatccacgatcggctctcctgtcctgacaccgaatgctttagcgggaatggactttgccagaatgatcccccgcctttttgatctgtcacctccgactgcgcttggaatatcacgaagatccacgcttcctccgtttttaagtctgtaaaccgcttcccaggagagaaatgcgctgtttacatcaatatgaaaaatgacgtttttcaacttaatcccacttccttaatctgtaactgctcagtaccctcacagtcatgagcgataacctatactgaatggtttccttaatctttctttatctatattatatcagaacatacgttctcagtaaatacttgacaaaacttccaacctattttattctgaaagaaataaattgaatctacaaaaggagtctgctatgctggctatcatacttgcaccattttatctcttgatcaattattatgtcgtccgctggatgatccgctggacaggcacctgccaccggcacctgaaatccagacctttccgggcggtttttctctgcatatatatttttatgtgcctgacgcccctgacctcctatctggtctccgtcaatccctggcacagttggctgaagcggctattcaattactggctgggcacatttttgtatattgtacttatcattattatctttgatatcataaggatcatattaaaacatacaaactggataaaaaatgaaaccctggctagacggcgtacctttatcctgagcggcggtgccgccgcctgccttatcatatgcctgagtgcctacggaatcatccatgaacaccgcctctatgtaaatcactacgaggcaagggttgaaaaatccggcggcaaactggaccatctgcgaatcgctctcaccgcagacctgcatctgggctacagcatcggcacctaccatgtaaagtccatggtggacaaaataaatgcggagaatgtggacctggtctgcattgccggtgacttcttcgacaatgagtacgatgctgttcagtatcctgaaaaaaccatctctattctgaagaacttgaaaagcacctacggcgtatacgcctgttggggcaatcacgactttaaagaaaagctcctggccggatttacggtacctgttaagaacggccagcataccgatgcacgtatggacaattttctggaacaggccggaatccggcttctggatgacaagtcagtgctcatagacgactccttctatctggcaggccgcaaagacccgcagcgctctaaaaaaatgaaggaagaccgcctttcacctgacgaacttctcaaagatctggaccaggacaagcctatactggtcattgaccaccagcccaaacagcttcaggagctggctgatgccggatgcgacattgacctctctggccatacccacgacggccagatgttcccgggcaatctgaccacaaaacttatgtgggaaaactcttggggagagttaaaaaaggacaatatgtattcctacgtaacctccggtgtaggcgtctggggtccggccatgcgggtgggaacagatgccgaaatcatgatcattgatgtctatttcacaaaataaaaccagtgtattttttaagggaaccggctgctcagtcttctgcagccagttccctcaatgcttttgccgtctgttccgcttcttccatagtattgaaccaggaaaaggaaaaacgcactgccccctgttcccgggttcccagcgcctcatgcatcagcggtgcacagtgcgccccggaccgggcataaatctcatatgtgcaggataattcatcgctcacctgcgcagaatcatagtctcccatattgagagttacaattgcagctctctctctgcacgtaaaatccccgtataccttaattcccggtatttccctgactgcctcataaaaagcccgtgcaagcttccgctcatgtgccccgatattttccactccgattttcttcacatactgtacagcactgcacagacccacgatcccgtgtccgttcagcgtacccgcttccagtctccccggcatgattgcgggatgctcccgctcaaaagaatggattccgctgcctcctgtcttcagaggccggatctccacttcctcccccacgcagattcctcctgtcccctgtggtcccataagccccttatggcctgtaaagcagagcacgtctatcccgcattcttccattcggatcggaaccgaacctgccgtctgggatgcatccagaacaaataaaatccctttcctgcggcagatttctccaatccttctgatatccagcagattccccgtaacattagaggcatgtgtacagatcacagccctcgtcttatccccaatggccttttccatctcatcattagaaatatttccgttctcatccgccggaagaatagtcaataatactccggccttctccatttcatacagcggtctgagaacggaattatgctccaaggctgtagtcaccacatgctccccaggcttaaaaagcccgcggatcactgtattcagcgcctccgtggcgttacaggtaaatactacacctgaaggatctcccagcccaaaaaagtccgcaatgacttccctggcctcataaatctttctggaagtttcaagtgtgatcccatgtccgcctcttccgtaatttccgagagtgcccattgcctcatagacagcttttctcacacattccggttttttcagcgtggttgccgcattatccagataaatcattacactcaccgtctttccgtcctatcggatgaacagatacttatcctgcagatccgtaacaaatcctataatacctgccttcaaaggatatcccgcctgttcaagctttctgagtaccgtctccgcgtctctcccgggcaggctcactaaaagtccccctgaagtctggggatcaaagaccagatcttccagtgcctcatccacctgttcctcgatcctgacatcctttttattaaactccttattcctgtatgtcccctcaggaaccaagcccatagaagcataaaaaagggcatccggcagcacttccagcttttttgtttcaatcacaagtgaagctttgctcgcccttgccgtctccaaagcatgacctgtcaggccaaaccctgtcacatctgtacagctatgtacctcagcctccctgagcacttccatcgctattttattcagacagctcatactctcaaccgcccttttctccgcctcagcagatgccatacctgccttcacagccgtattgatcaggcccacccccaaaggcttagtcaaaagcagcacatcgccagcctgcgctcctccattcttccaaatcctgtccggatgcacaaatcccgaaacacagagtccatacttaggctcctcatcattgatcgagtgtccgccagccagcactgccccggcctcctgcaccttagaagctccacctgccagtatctcccccagcacctcagcgcccaggcagttagggaaggcaaccacattcaaagccagccgtggctcaccgcccatggcataaatatcactcagtgcattggcagcggcgatctgtccgaatatataagggtcctccaccataggcggaaaaaaatccacggtctggatcagcgccacctcatctgacacccgatatactgccgcgtcatctgccgtctcaacccccaccatcaaattttcatccacagccgaaggcagtctcccaaccacctccgccaaaacccccggcccaatcttagccgcacaccccgcactcttagaaaactccgtcaatttcaccccaacacccataacaatctcctatccaagcccattcctctcaatccatacataatttaatcttttaatctttaatctattatttttaatcttttattttcttgtcctttattctcttgtctttttgaattttttcttttttgtccctcttgtcttttttgtctttgttatctttttgactttcttatctttttgactttcttaatttttgtccctcttgtctttttgtctttcttatctttttctctttctcattttttaatcttttttgcctttcttcttttatgtctttcttcttttatgtctttcttcttttttatcctttatctttcttcttttcctccatccccatgggataccagccaccagggaagcagtctgtgagcggagggcagccggggcagagggcatcaggcaggcggtgtttcgcggagcgggcggaagatccacctgccccagacacttagcgaagagccctaaggcgatgagcttagtgactgggagcaggttagcttctgcccagcggagtgctccgtctgtctgatgccctctgccccggctgccctccgctcaccgactgtttcccgtccgccttaacccatctcccctccgctcaccgactgcttcccgtccgccttaacccacctaaatttctataaccacttctaccggacaatgatccgacccaaacacctccgtatgaatccccgcagaaaccaatttctcctccaatctctgagacacacagaagtaatcaatcctccaccccgcatttttttctctagccttaaaccgataagaccaccaggaataaattcctgtctcctccggataaaaataccggaaactatccgtaaatccagcctccagaagctctgtaaacttacccctctcctcatctgtaaagcctgcattatgcctgttcgtcttaggattcttcagatcgatctctttatgtgccacattcagatctccgcacatgaccactgcctttttctcatccagctttaaaagatacgccctgaacgcatcctcccactccatcctataagataaccttgccagctcgttctgtgaattaggcgtataacaggtcacaagataaaagtcatcatattccagagtgatcaccctgccctcctgatcatgctcttcaattccaattccataagccacagaaatcggctccttcttggcaaatattgcagtacctgaataccctttcttcaccgcataattccaataggcgtaatatccctccggggcaaaatcaatctgtccctcctgaagcttggtctcctgcagacaaaaaaagtccgcgtccgcctcctgaaaatactccgtaaatcctttctgtacacaggcacgaaggccattcacattccatgatataaatttcatatactactcctctctgttcctcacaaatattttaaaatttcccggtaagcatccaggatcgtctcatatttcataccgcagtttgccggactggttgacggaagctgtatcaccggcatacccgtacacggctcacaatattttctgtaaagcgctgccgccttctgccctgtagcaaaaacagcttttatgggcgcagcttccagcactactgacatatcatttgcagccggatttttaatactcccgtcatccgccccgcgtatctcacagcttttgagcacatcccacactgcaaccttgtgagccagcagcatccttttcttctcttctattgtaccgggagtctcttcaccgagcacttcccccatcactttccagaaccggttcctggggtgcccgtagtaaaatccttcttctctggatttaggcgaaggcatggtccccaacagcagaaccctggaactgctgtcataaaccggtgcaaacgtatgcttcacatattctgtctgatttttcatcggctcattcccatatagatgaaatattgtaaccattttccaccttcacggtaacaggcaaaatccacgctgaatctcctcagatcatagaatttctgtccggctgcccaacacattcatacgggcagcgcggtccatgcgcagacctgccaaatgatgacgaaatatttacatcttcttttcttttataattgtagaattttacttctttcgtcctcattatacactattttttctctcctgcgaagtaaaaaaagttggcaaaacgactttacgaacccagtcttatgagtatataataaagactgcatcggaaaaactgcggaaattgcacacagtgaactttctgtagtcacaataacagaattcttatgaaaaaggagaaaaatcaatgggtggaatatttggagtagcttctaaatccagctgcactctggatttgtttttcggaacagactatcattctcatctaggcacaagaagaggcggtttggcagtctatggaccaaatggattcaaccgttcgattcacaatatcgaaaatacccccttccgcacaaagttcgacggagacttaaacgaactggagggcaatctgggtattggctgtatctctgacaacgagccgcagccgcttttagtacagtcacatctgggcagcttcgccatcactaccgtgggaaagatcaacaatatggaggaacttgtggatatctcttacaaaaacggatgtacgcattttctggaaatgagcggcggaagcatcaacccaaccgagatggtggcatccctgatcaaccagaagtccaccattgtagaaggcatacagtatgtacaggagctggtggaaggttccatgacactgatgctgcttaccccaaagggaatctatgccgcccgtgaccggatgggccgtacccctgtagtcctgggcaaaaaagaagatgcgttctgcgcatcctttgaaagctttgcctttttcaatctgggatacgaaacctgccgtgaacttggccccggagaggttgtattcctcaccccggaaagcgctgagactttagtaaagccccgtgaggaaatgaaaatctgttccttcctgtgggtgtattacggctaccccacctctacctacgaaggcatcaatgtagaggaaatgcgctatgaatgcggcaagaaactggcacagcgtgatgcccagagagaaaacgtaaaaccggacctggttgccggtgttcctgactccggtattgcgcacgccatcggctatgccaatgaatccggcattccattctcccgcccgtttatcaaatatacaccaacctggccccgctccttcatgccgacacagcagagccagagaaaccttatcgcccgtatgaagctgatccctgtggaagcgctgatcaagaacaagagtcttctgctgatcgacgactccattgtccgcggaacacagctccgcgagacaacagaattcctgtacagcagcggagccaaagaagttcatatccgtccggcctgcccgccgcttttgttcggctgtccgtacctgaacttctcccgttccaaatctgaaatggatctgatcacccgccgtatcattgcagaccgggagggggacaatgtctccgatgaagtactggccgactacgccaacccggattccgccaactataaggaaatgctggaggagattggcagacagcttaatttcaccacgcttcactatcaccgtctggatgatttgaccgcctccattggccttagcccttgtaaaatgtgtacacactgtttcgacggtaaaaaataaaatcatctactgaaaaaagcagctcgctttggtagctactcataaaacagtatcacaacaaactgaaacagggtagctgccattcggggtgcaaagcaaaacgggcgtatcgtctaaacggcggtatgcccgttttgttacgcagtagaacgccattttgaggggtacgagtataaaacccttacctaccctcattatgcctttgtaaagccgcatgaatacaggcttttttgccccctattgcgtgacagagaaccccataatttagagagggcgcaagtggtctatccgtttgcgccctcttgactaccacatagcaaggacatggaaaaccgtcaagggcggcgcagccgttcatcttgacccttgacggttcttcatggctttgctacttatgcggcggctgatagtccagtcggaacttcaaaaccgccatgagcagctttgcgtttaatcgctctttcatatcggcgttccctctgcttagtctgcctatgtaggctttgtgtcgttcctgtatcgcaaggagcgcgatggtatcgcccgtaattgctctttcaatcacttcataggaaacaaggttgtatttgctattcttcatctttcatcttctccatttctgcccgcaactgtttcaaagctgcgtttttctgataattgacggttgtgcgcggttttcccaataacgccgctatctgcttatcatttagttgcagataatagcgcataaggataatttcccgccaccgtttcgataggcacaacaaggcttttgctaacttctcactgtaaacaattaccgtctgtccgttgaccgcaaaggcagtcggcttgtcctgcaaaataaagtattcatctgtgctgtgtagcgcaaaagaggtattctcttgcaagtattcaaaggatatttcatgctttgctttgcgtttcctttccctgtaataattacaggcttcattgtgcaatacggctttgcaaaatgcgtggaaccgccgttcaatactttccctgtattctgtggataacatcattctcacccccttcccgtttggaatgagggctataacaaaaaccgcctgtgcagcgcgaaactgagcaggcggctatgctatatgatgtaacaaagcatttatgatgatgtgagggttcctcttgatagccgcaacatcccgcaggcaggaacaggctttttttgataggctactgattggaaaacagtgttgatataaagcaaacatggcgatacccccttgataccgccgtatccttaaacaagggcgactttaacacaccctccatattcctatttttgaaaaagaaaacggcggctttgattgttatgtcaaaaccgccgcccaaaactataaccgcaattcgccaacaagcaacggttttgtaagttgcaatctaccagcaatcgcataggcagaatgtagctgtcaaagaaagagccgataaccgcatttcatatctgcgtgttatcggctctgcgtctttgcgtctggctctttgataactgacatatttagttgtttcacattgactagcgtttcctgtttgcacttcgggcagtacagggggaagttttcaagtatcgtatcttcccgtattttcaacctcgttttactttgacatataggacatattatccattcagtttccatgctaaatgccccaattactactaatcatttgcagctttaccatatggggataaatcttgcccgtattcatcagttgctttggcgcaccttgctccgcaacgcagccgtccgaaagcacaaccactttatccgcgccactgacagtacgcatacggtgagcaataacaagcacggtcttatcctttatcagccttgacaaggcagcctgtatcagtgtttcgttttccacatcaaggcttgccgttgcttcgtccagtaaaatgataggggaatttttgagaaaagcgcgggcgattgaaatacgctgcctttctccgccggacaattcacaaccattttcaccaatcatactgtcatatccgttcggaagtttctcagcaaattcttcacaatttgccagctttgccgccgcgatcacttcttcatctgtcgcgtcttttctgcctattctgatattctccatgatggtattgttaaacagcgtcacatcttgaaaaacaatggagtacagcgataataatgtttccggttctatcttcgatatatccataccgccgacagtgattttgcctttggttatatcccaaaatcttgccgcaaggcgcgacaccgtcgttttgccgccgccggacggaccgaccaatgcggtaacttccccttgttttgcaataaaagatacatccttcaatacggtttccccggtattgtaagcgaaccccacatggtcgaaaacaatatcatagcctttattagttacccggcggctgcctgtctgaattgggtgatcaaggatttcattcatgcggtctatgtttgttttggtagaaatcaccgccgcaagattttgcaatgcgccttcaagcggagcatacagccttgaagcgacaagtaaaaacataaagaacagcggaatatcaatctccccacgaatgagcagagctgaacctacaagcgcaaccgtggcaattccaaactttaatatcagcgtggacgagacaacaaaaagggccgttccaagttctgaaataatgtgccgcttttctacataatcaatctttctgctgagtcctttcagataactttcttccgcattattggcttttaagtcctgcaaactctcaatgcactcctgcacaccgctttcaagagcgacatttgcggctacggatttacggttaaaatatccttgtatgcgggctgaaaagaatgtgattgcaaatgcaatcggcaaaacccaaaccgccgcaagagccatacgccaatcgtaaacaaaaaggcagatcgcgatcagcgttgttgaaataatggagcctgctaaggcggggacataatgggaaaatgctgtttcaagtgttgcacagtctcccataatagaatttgtcaaatcggcaaggtcttttttgccaaaaaaggataacgggatttttcggagctgctcggctaaggaaatacgccttaccccactttccacataggttgctaaataagtagtgttatattgaaaccaagtcgcaataaagataaagcataagcaaaccaaggcgccaactacataaaaagctatgcgattttcactcacaccgccattcatagtatccatgacaaagtaatacagaagcccgacaggaaacataaaagatatatcctgtgcaacgcaggcaatacatccttttattaaatcgacagccccctcttttgataacgcaaagcgtctttgcaatgtcttaatcatgcttttgcctcctttgcaattctccattctgccgcttcggaataattcttccacatacgcgtaaatatgccgtttctctctatcagtttgctatgtgtgccgctttcggcaattttgccgtcttgcagtacataaatgcagtctgcgtctgtgattgacgacagcctgtgtgcaatcataatcaccgttttcccttttgaaagagcagataatgcctgctggatcagcacctcgttgtcagggtcggcaaatgccgtcgcctcatcaagaatgaggataggcgcgtttttcaaaatggcgcgggcaatcgctattcgctgctgttcgccgcctgacaggtacaccccatttgttccgacaacggtatctatgccgttcggtaacttttcaataatatccaggcactgtgcagctttcaaagcatgggtgatttcttcgcgggttgctcccggctttgccatacgcacattttccaagatagacgctttaagcaggcggctgttttgaaacacaaaagacactttattcatcagcatttctttcggaatatcgcgaatgtcgatatttcctatcagtacgtgcccctccgtcgggtcaaaaaatcttgtcacgatatttgcaagggtcgtcttgccgccgccggacgcgccaaccaacgcgattgtctgtccctgctctatccgcaaagatacatcattaagtgcgtttttctccccgtcatagctgtaagtaacgtgttccaatgcaatcgaattatcagacggtatattgtttgcctgactttcagacagtggcttttcgtttagcacttcatcaatcctgcccattgcgtcacttacaatcattgcgtcctcactcataaacatgattttagtgagtgtcgtaccgataacaggcgtaattacaatgtagaaaataagattcagcagcaattcatttgttactccgccccttgtaaagagaatacctccggcgattagaaaggcaaatacaccattgattgcggttgtataaaacatcatagggagccttaacgcttttgtgtatgcgatgacccatttttcgtaattatcaatcgagtccttgaagcgtttgaaagagaaaattgtctgcccaaaagtctttacgacgggtatgccccttacatattcaacggcttcatttgacatatcggaaagcgaattctgatactgctccattctctgcgccatatcctttccagtcattttcatcatgatcagaaagccaagcgcaacgggaacaaggcctagaagtcccagccgccaatcaaacgcgagcagtaaaaagagcagtcctattggcgtggcaatcgcccccgctttgtcgggcagcctgtgtgcaagatacgtttcggtagcggcactggaactatttacgatccgtcgcagtttcccgcttccatacttttccgtcactccaagcggcagggttgtgatatgccgcatcagctcttttcggatatttgcggccacccgaaacgcgctgatgtgtgagcacatgagggcggctatataaacgacaacagatataaccgcaaacaacacggcagaccagccataacgtgtgacattccccgcctgtgaaaagtccggggacacttccagtatgtcgtgaatgatgcgccatatataccaaaaaggcacaagagccaacagcgcactcgttacggacagtacccaagaaagataggttaatattttatgtttcccggcatactccatcaatcttgatagatcagattgctttttcattgaaaaaacctccttaaaatgatttatgatatgaaaacgcaatatgcgttcccgaatatccattgcagcaagttagttgttgctaacttatatgtaaaaattatagggctcattgccccataattttcatccacccagcggtgtaaaaagctctcatctcttttagataatgctttgcttcttcaatcggcatttcatgtataatcaactcaaaaaatgtattaaacattccggtaatcaatatatgctctaaccgttcatcaataggcggcgacggtctgcctaacttttcaagtaccgccaaataatcatgtgttccttttgtttctatctctaccatttcatcaatcagtttagaaaaacgcgtcccctctgaacagcaaagaatgagcttaaattcattcaaatgttcataggcatacaaaagcatttcgtacatacactcgccggaagtgttggcaagattatttggctgttcttccggtgagatgtcagcaaattccttctgtgccttggaaaagcagttcaaaagaaaatcatactgttcgcctaccagcgcttcaaataaatcttccttgctgtgatagtaaccatagaacgcgcccgttgtgacccccgctgttttgacaatatttcgcaaggaagcggatttgaaacctttttcaagaaattcctgcatggcggctgaaagaattagatttaatgttgtctgttccgcttcattcattaactcacctctcgcatataacgacgttatatatcactgttatatggtacaacaaagagaagacattgtcaatagttttaaaattttggcattaaagaatttggcatttccggcttgttacccgtagtaggaagagagagaaagttttttcttaaatttttctaaaaacttcggcaaaaccgccctgtgcggtgttgtaggtagtgaaaggaggcaactcatggaaaacagaaaacgaaacgtacaaatcattgtccgcgtgacagaggaagaacgtgcattgattgagaagaaaatgcagcagataccgacaatcaatctgtccgcctactcccgaaaaatgctcattgacgggtacattatccaactggatatgcaggacatcaaagcgcatacggcgcagcttcaaaaaatcggtgtgaacgtcaatcaaattgcaaagcgtatcaatgaaacagggcagatttacgccgacgacatagacgagataaagcgtgtcatggaagaagtttggagattggaacggcggttgcttctgcaattcaaggggcttagtaaatgagggtttgggaaacttcccaacaagcgttttgcggagcaaaacacgcaacaggctatcctgttgctatgcttgctactcaaaaagaactacagaaaggacgggcatatcatggtaaaaaatccacttgcttatgagttaccgaagcgtgaagtagtgataaaatccggcaggacgctctatcggtttacgggcagctatgacgtggaaaggagcctgccccacaaggttttgcgccttatggagcaggaaaatccaaagaaagatgttgattaaaaatgccggagccgataaaataggagtatgcaatcctgtattggcagactgcccgccgatgaaaggagcagaaattgtgcaaaggcagtctgacagaattaccgccctctattgccgcttgtcacgcgacgatgaattgcagggcgacagcaacagcattgtaaatcaaaaggcgattttgagtaaatatgcaaaggaatacagcttcaaaaacaccttgtttttcgtggacgatggatattcgggtacgaacttcaaccgtccgagctggtgcgaacttttggaacggattgaaaacggcgaagtggcaacgttgattgtaaaggatatgtcgcgacttggacgcgattatctgaaagtaggtttttataccgaagtcctgtttgtggaaaagggcgtgcggtttatcgccattaacaatggtatcgacagtgcaaaccagcaagacagcgactttaccccttttttgaatatcatcaacgagtggtacgcaaaggacacgagcaagaaaatccgtgctgtgatgaagtccaaaggagaagcgggagaacatctctgtaccaacccgccctatggctacatgaaagacgctgacaatccctatcactggacgggtgacaccgtagccgacattttggaacgtccagagtatcaagggcatacggtaaactttaagacctacaagcagtcctacaagagcaagaaaacctgttacaatcccattgaaaagcagcttgtgtttgagaatacccatgaagcgattatagacgctgatacatgggaacgagtacaggaattacgaaagaataaacgccgcccaacgaggacaggcaagactaatctattctccggcactgtccgctgcgctgactgtgggaaaaagctatattactgcacaagcaagaactttgaagcaaggcaagaccattttgtttgctctacttcaaggctcaaagggaaagagatttgcccgacacatttcattcgtgcggtggtcttggaacagggtgtacttgctcatatgagattgacgattgcctgtgtcgctaaccacgaagaacaattccgaaaggctatgggcgcgaagcagaaagccgaagcgaaaaaggaactggtggcgaagcggcggcaactgacacaagctgagcgacgtattgaggaattggacagactattcaagcgtatttacgaggataacgccaacggaaaactttctgactgcagatttcaaatgctctccgacgattacgagcaggagcaggaagaactgcgggaaaagctgttgcaactgaatgaagaaattacacagcaggaagaacaggcagaaaacattgacaggtttatcagcaaagtgcggaagtatctcgacttggacgagctgacgcccgccattttgaacgacatggtaaaggcggtatatgttcatacgcccggcaagtcaagcggtcaaagggagcagcagattgatatatcctatgaccttgtgggaatactccccgcgtctttactgaatgacctgcaaaactgagaaacggcatagccgaagctacgccgtttcccaaaaacaatcctatgctgttttatgagtgcctccctttggagctgctttttttacagagcctgaagttctgaaacagactgcagcacatcctctttctggctgcactctatcgtaaaagataccttcggattgttcttttttattgtctttattacctttttataatccaggtttccttttcccagtccccagtgggcatccctgtctcccatattgtcgtgcacatgcacatgtttgatataactgccaaacagttctgcccatgcggcagccggcatatctgaatagcaatgtgcatgtcccatatccagacagattccaaaatcaggatgatccactttccgaaccgcctcaaggacaggctccgcctccctgtcaaacacattttccatcacaatctggattccttctctgccttccagaaaacgcttataaaaatcagcgaccctgtcagcccacccaatcagcagatatacatccggcacataacaggtatggaacaccagcttgccggcgcccagcctctttgccgcccagtacgcctgttcatatcttttccttgtgacatccaggatcagagaatcaaaagtcataggattcagatccaaaaatggcccgtgaaggatcaggtttctgcaccccatctcctccagcctcttttcatacctgtcagctttctcttccagacagtccaggttctctgaaatggcaaactctatactctcaatacctgcccctgtctgtcctatcacttccctcatatccatgtcatccagcaaatgactcacataattcatacttcacccacccagtctgatcataatgtaaccgtgctgtacctctacagtttctagtattccatctaactgtccggtgcccacacagcttctgacaaaaagcaatctatcatttatgataccacaaaatatcctataaatctctctttcccccaaaaaagaactgctgtatctccacagcagtcctttttcctaataatctgtcttctgataaaaatgcccctccagaaaatccgtcttgatcacattgataaacgccttggggtctgcctttcgcactcttgtcaccagcacttttgcctccgcgctggaaactacggagtacagcatcttccgcccttcgttggaatagcatccggtagcggcaaactccgttgcgctgtgattggtaacctcgtaaatctcctgatatacttcatcgggacaatctgtaacgataaacagggtctcttttttatatgctgtgtgaagcatatggatgatctgtgtggatgtaaactggaagatgatagaataaagagccttatcccatccaaacaaaatacccgcgatcaccagcacacacccgttgcccagcaggataaaattccagacatccctgtttttcttctcagcgaaataaatagcgataaaatccgtacctccgccgctggttcctcccataagacaaagactcacagcgaaaccgttcagcagtccgccgaacacggagatcagcaggatatcctgggtgatcggctgatacggtatgatatcggtaagaacactggtcagcacaatgatcagggccgaactgactgtaaatttcttacctatggctttaaagcaaacaatcgttgggatcgcattcagaaccaggttgatcagtgtaaacggcagggcgattcccataaaccgttcaaatatagtctggatcagaagagtgactccattaaatccacccggatacaaaccgcctgcccttacaaatgttttaatatttacagccatgataatggcgcctgcaagcccaaagacaactctctttgcctctgttttaaaatcaatattcgctttcatttttcctcatctgctgttcttacagcatgtgtttccgaagttcctccggagattttacagttaaataggccggcgcaatgtcaaagacggttctgcatccgctctgtccttcccggttcagacgatatgccgctctggcataagccacaatgacagaggacgtgaactcagggttggaatccagtttcaaactgtattcgatcacatggctgtgctcctgttcccatcctgtcttacctgtacggatcacaaatccgccgtgaggaagcccggcatgttctgccttcatctgctcctcgctgatgaaatgtactgttgtctcatattcatcaaaataatttggcatggtcttgatctctttttctatccgctctctatcagcgccctcttctaccgtcacaaacacctcacgggtatgtttttcacctgttgtgagtgtgggattctccccgtttctgactgctgtaagagctttttccacaggaatggtatactgccttgcatccactacgccttcaatccttctgactgcatcggaatgtccctggctgacgccttttccccagaaggtataatctgttccctccggcagaacagcattggcatacagacggtttaaagaaaacattcccggatcccagccaacagagatcaggccgatcttaccgctcttctttgcggctgcgtccacatctgcaaaatgctccggtattttcgcatgagtatcaaagctgtctactacgttaaaatactgtgcaaactcaggtgtctgcttcggtagatcagtagcgcttccgccgcacaggatcaggacgtcgatctcatccttcatcttcacagcctcatccacatgataaacctttgcagtctctgtcatgatatggacgtccgcaggattacggcgtgtaaaaacagcagccagttccatatccgggttctgttttaccgcacattccactccgcgtcccagattaccatagcctaaaattccgattcttatactcatcctttacctctcctgtcaatttttctatagtgtatacgacaaagccgttttgtaaacaaaccgtccttttcgtctcactaagtataacaaattccctttttcacttcaacctgcaaaattcataaatcaaccaatcccaccatagaaaattcctaaaatatacacaacaaaagtcagtcccacaaagagatattttgtggccggctcgaaccattttccaagaggttttctgcgtccggtctgcacctgttctctggcaaatcccctgggcgctgcccagaaaaacatcactgccgccagaagtgctcccagaggaataatatagatggaaaccacatccatccacacactgaccatatcagcactctcaataaagattcccacagcggcagcggcaaacgccaccaggatcaccgccatctttctggacaggccaaactgttcctggagcgcctcaatgggcgtctcaaagagattcatcaaagaggtgaccgctgcaaacagcaccgccacaaaaaacaccactgcgaacacctgtccaaaaggcatctgtctgaagacctcgggaagggtaatgaacataaggggcggccctgctgacacatccaatccaaaggcaaaaaccgcagggatcactaccaggccggcaaggatagccgcacaggtatcaaaaaacgccacgtttctggcactctccaccacatccacatcctttgacagataactgccgtataccagtgtgccggaaccggccaaagacagggaaaagaacgcctgcccaagggcaaacacccaggtcttgggctgcatgagatattcccatttcggcacgaagagatatttatatcccgcacccgcatttcccagggtcagcacacggatcatgagaaataaaaagaatataaaaaacaggggcatcatgatcttgttcatcttctctatgcccttggaaaccccgaaagccataataataaaggtcacagccagaccggccatatgccagcccgtactcccaaagttaccggctatctctccaaaataggctgagacatcagcggtgtgaaacatgttccctgaaagagacccccacaaaaaccgcagaaaccagccaaccaccacggaatagccgatgccgatggccagtgagccaaggacagggatcattccgatgagccttcctcccttcagcccccgcatctccatcactttcccgaaagcgcccaggggtcctgtcttcatagcgcgcccaaaagccatctctcccaccactccggagaatcccaggatcgccacgaatataaaatagggaatcagaaaagccgctccgccgtactgtccggtccggtaaggaaacatccagatatttcccatccccaccgcagaacccacacaagccacgataaaaccaaattttgagcggaaggcatccctggtccgggaggttcccgctgaattctttttcatattttgtcccatccttttatgtaagattttcagacatacgttagtcctttcaaaggataacacacaacaaatgtactgtccatacgcaaaaacagccgtaatgatttctcattacagccgtcttttttgttttaacctttcacgccgcccacaacaataccttttacaaaatacttctggaagaacggataaatacataacaccggaaggattccgataaccgcaatcgccatcctgatccccacactggggagctgtgacagatccacattggaggctgccgcactctgtccgctggtaaggaactggatattggtgatgatcgtgttcaaaatcgcctggatactgaacagcttttcattcgtgatatagtaaaggctgttcatccagtcattccagtaacccagcccgatcatcagcgccaacgtagccatcattggttttgaaaggggaagcacaatcttaaacagtatcttatattcccctgccccgtcaatcctggcagcttccaccagtgcatccggtatatttgcagtaaagaaggagcgcatcatgatgacgtaaaaggcattcatcaaaagccccggaaggatcagtgcccaaagtgtatccttaatatgaaatgtctgtgtccacatcatataagtcgggaccagacccccgttaaacagcatggtaaaaaatacgaaaaacgaaaacaggtatctccccggaagctcttttctagataggggataggcaaagagtgtggtgatcagaacactcagcacagtacccaccactgtgacaaaaatggtaatcccatatcctctcaggatcttcgtgctgcttttgaacagataggcataagacgccagactgaactccttcggccagaagctgtacccttctttcatgagtacaggttcactggtcagagaggaggagatcagcagcagaaacggcgccagagctgttactgccagcagaatgaagataatgttcaagacgatctgtcctgttttatttttactgaccataatttcctcctttctcagaacagtgcattttcttcatcgaccttacggacaataaagttgacagtcaggaccagtataaaacccagaacggactgtaaaaatccggctgctgacgcacggcctatatcatttaactgggtcagtcccttataaacgaatacgtcgatggtatctgtcacggatgatatcagcccggagcgcatgggcacctgataaaacagaccaaaatccgtgtaaaacatacgtccgatattcaaaagcaccatggtgataattgttcctttcagccccggaagtgtcacatgccatacctggcgccaccgtccagctccgtccacagtggctgcttcatagagcgcagaatcaataccgataaccgttgcgtaatagagaatactggagtatccaaatcccttccaaagatttacaagaaccaatataaagggccagtattttgcctctgtgtaccagcttacagtatctccgcccatggaaacgatcatcttgttcaggaaaccattttcctgactgagaaacccaaagactatgtaagaaaccacaaccatggatatcagatatgggatcagaattactgtctggtagatttttttgttcatcctgccccgcaggaagttcagcataacggcaaccgcaaccgctaaaagatttcccaacagaatgaataccaggttatagcagaccgtatttcttataatattcagggcatcctgggttttaaacaagtaagtaaagttgctcaaaccgcaccagtcacttccccatatccccttgctgtagtcaaaacgtttgaacgctatgaccaggcctgccatgggaatataattattgatgatcaggtagataaaacccggcagcatcatggacagcagagccagagtcatttttctcttggccatcttccgatgaagtccgcctgccggtttaaccgctgttttcgccatgggtttccctcctatctgcctgccaggaaggtgtcgagctgctcctgttttgctttgatgatatcattcaaaccggctgcctcaaactccttatcagcctgttcaatggtgctctccacatccacagttccggacataagagccttatagtatttgtccataacactgcagcaggcagcatactgatctgcaacttccgttgtgtcaaaagcgaatccgaaggctttggatttcatggtctcctcattgaatttcagcagatcctcaaagaaagatgctccgttgacatccagaggaaggctgtttgcagagtaaggtgtgatccaatactcatcagccatgccgtaaccgcagtcagcggctgtcttgccgtccgggaaagatatggtgccgtcatcattttttacataatgcgttccctcaataccgtcatttaaaagctttgagacttctgcatctgtgtacaggatctccataacttcccaggccgcatccttgtctttggagttcatattgataccgtagcacagctccgaataggaattagccacagcccatttatctaaaatgaccgtacggatcataccgttcaatccgtttacaccataattatcaaggcaggcaatcgcctgtttattgccgatcatggtctgccatggctgtgtattgctcagaatatcctgcatgatcaggccgtccttgtaccaggctcgtgtccaggtgcagaattcccggaaatcttttgtatcaaacaggttctgtacctctgtggactgtccgcattccggaaggacaccgatgtatttactgtctcccagaccatcccagctccactgtccgataatcgtatccgttccctgaggtgccagcgcgtaacggtcaggatacttctcgtgtgctgcccttaagaaggtatccacgtcctccatagtcagcttctggccttcctctatgccaaattctgccgcaatatcggagtcgatattcaatccaaaatagtttccgaaattcctcatattcggcactgcataaatctttccgtttaccgttgtaccctgcatctcctcctgggaccacacagctttaaacgcatcagatgccttgtcgtaatactctgtcaaatccacaagctgcccattcttcacatatgttgtgagcggtgtggagtatacagcgatcacatctgcctcgtcaccggtaaagagcagattggactgctgcagccagtttcctgttgtaataaaattcagatccaggcggattttatatttctcctctgtgatcttgttgatctcatcctccactttctgcgcatccggcagatcatatacggtagggatatggacatttacagtttttacctcatctttcccggattcttttgaagaggcactatccccgcctccgcaggctgccagggaaactgccatggccgccgcactgatcacagctgctgttcttctgatgttttttctcatttcaaacatcctccattccttttcttttcctgcccatcgacaagctttatgatgtctctattttatccgggatctctgtttttatctgtaactttcatgatgggaattcgtacttttgtgatgttctgcgtgactcctgccatagtcccaccggaattctgccactttcgtgataggtcctgtcgcttctgtgacttatctcttctgattgtcctttctgtactcctggggtgtcatctctgtcatttttttaaacattttagaaaagtgagaaaaattgtcatatcccaccttggacgccacaatactgactgacagatgggtctctgccaaaagcttcttggctgctttcattttctccatcatcataaaatctttgaaggtatcccctgtttcctgtctgaacagcctggaaaaatactcctcatttaaatgtaccagttctgccacttccgctctggaaatatttttgctgaggttttttctgatatatttcactgccgtatcaatgggatctatctcatctatatgtcctgctgcctccacatcatcccaatagatccccggctttttctccctatttccctcgatccgcctgcccagacgcatgaatatatggctaaaggcatagtcctcgtccagctctgcaatgggatatacgctcacagagaaatccatattttcattgacaaaagcataaaattcttccagtctcctgtgccacagctcctccccaaccgctcctctctcagccgcaagaaacagccagtagcggttctctctgaggcaggaaatccctgcccgaacatcctggtccgcaaacagttcctccgcaatattgcagagagtcatgcgtaccaaattttcctcccacgtttctgaaagccttttccactttaaaatctgtacaagaacaggatgtacagcacagctgtcatactccatgcggaacatctccacataatgccggtatatctggtcagcttcctcccctttatcccgcgtcattttggagagcatggcatccaaaatagtatttctctgttctatgaccagctttctggtattttccaggcggcgcagttttttcctgctgctgatgttatcccatgcttttaggagcactgcctccacctcttcgtatcttacaggctgcagcacatagtcaaatccccccatagcgatagcctccttcgcataggcaaaatccgcatgggacgtgagaaaaatgcattctatctcctggaactgctcttttgcccatctgcacagggacagaccgttctcctcgggcatttcaatatcactgaccagtacgtccacctcaaaattgcgcagcaccagctttgcctcctttgcgctgcacgcagtatagacctgactcacaggcaatttcccccactgaattccattcttcaggctctccacgatggccttctggtcatccactaataatacattcatcgttttgcttctcctccggtaatattaactcactcatagctccgtcctgattggtaaaataatactctgccctctccccatataaaagctggcagcgccgctttatgttgttgatccccacactgcggctgcctgtatttgtttctttgttgatctcctccaaaatttcctcaggatacccctgtccgttatcctgaatactgagatccagaaaacgtccctcctcagtcacgagcacatctgccgtaatctgaatctgcaggggcacctgcacacttccgaatctggcatatttcacactgttctccacaaatgtctgaatgcataataccgggaccatccactgctctgcatcctccacagtctgcacctcacaaaaaacctggcgcccggtcacatgtttctgcagttctacataattttgtacaaattcaatctccattttcagcgttaccgtctccctgtccacctgcagaagataacggatgtgttttgacagattcagaatcagctcctgcgtcttatctgtctccttctccaggaccaaggcattgagggttttcagcccattcagatagaaatgtggttttaactggagctggagatattgcatctgtgctttctgcttctccacagcctcctccacagttctcacccgctgctcttccagagcctgcaccatctgggacagggtgtcattgatctgccttatttcataaaaccgcgcatccatatccggaaccacagcactctctcccgctctgatctcatccataatctcagtcagtctgcggataggtgtgagcacctgcctcctggtaaatcgatacaacacacagacagccagtacagacaacactgtgacaataagcagcagcaactgctgtacattcatcacactccagaggttggtttcatatgctgtaaaaatccagagattagtattgcggatccgctcaccgtaaacctggtattttccgatacgattcgtgtattcttctctggagtcctgcacctttcccggcagttccaactgtttagccagctctttgttcttcagaatgataccgtcctctaaaatcatcacatccggtttttttcccgcgctttcctgcacctcattttctatattacccagactgtgaagcccgtacagagctacctttcccttctcacaactgatggcaagacagacctcatcctctgcggacactgtcacccagctcctcatctgactctccctgctgtccggcgtatttagatttctgttcaaaagctgggtgagcagatttttcagaaccggagccttttccggtgcgatcagctctgtgttcacattgtaccagggttttgtcctgcccccgtagaaaatataatagccgtgcagattctcctcgatcagcattttctggttcatggtctcctttagttcccaggcatctccatattccagaacatccggctgtatccggctcagcctgtcaaaattatcgtcaaaagaatagatgtcatagatgagcttgtccaccttgttcatggctgcctctgtgctctccacataagtatggagaaggcccttctcctgttctctgttcttacgctggtactccccaatgagataccagtccatacacaacataagtatcagcagcgccagataacctatcatcattaccagaactatagttctattgagatataaggttctgtgtgttcttttcatgatcttcccccttatgatataaatgcaaaggagccatagacactgccggacgcatccgccagtgtctatggcaattacgattctaaaataactgttcagaataccttaacagttactttcagataacatacagaccttatttacagaggcaaaaatgagcctggttttctgttgtgctgtcagttccgataaacaccagaaaatcccccggttcactggcaaagccgttactagcggtatggaaacgcagcataggttcatcgatgaaaaacacgatttcccgctcctcccctggctccagcgttactttctcaaatcctttcagctcctttaccggacgcaccacactggccgccacatctctgatatatagctgtactgtctctgttcctcttcttgtccccgtatttttgattctcacacctgcccggacagtatcctgcaggcccatctcctctttatccaacacgaccggcgatatatggaaatctgtatagctcaacccatatccaaaaggataaagcggctcattgggaatgtcaatatatctggaacgaaaacgctcctgcatacctttcctgttgggccttcccgtaaaaaactcattatagtgtactggcacctgccctacacaataaggaaagctcatgggcagcttaccggacggatattcttttcctgtcagcacatccacaactgcatttccgccctctgtaccgggacgccatacttccagcacagctctggatttccctgcgatctccctgatatccagagggcggccattgaacagaaccacaacaatattaggattcaccgcccggacagccctgtaaagctccatctgtatctccggtatggtaatttccccgcggctggcagcttctccgctctgcaggtaatgttcccccagaggcatgatgaccgtgtccgcattttttgctgccttcactgcctcagaaagcatctctttttgttcttccgctgtgagttcttccgtagcgtcctcccggaaatctgccggctgaaatccaacaagtccgctgtcccctcccataactggggaacctttcaggtatacagtcctcctgttgtcaaacacgcgttcggctgcctcctttatcgtcacacagtccttatcatcccctgtaaaagaccaactgctctttatctgtttttcatctgtaaaaggcccgataaaagcaatttttttattcatatctagcggcagtatcccgtcatttttcagcagtacaaaggatctcacagccgcttcccttgccagttcccggtgttccttacacaggatcacttctttttctttctcttcatcagcgtccttataaggattctcaaataatccaagtttatttttaagctccagtatccgcatgacgcattcgtcgatccgggagattgacacctgtccctcttttaccagattttcaagattggcagcatacacatttgtcatcatatcaatgtccacacctgcctccagtgcttttttcgctgcctctttgctgtctttggcacagccatgggcaaccgtctcaagtatggcagaaaaatctgatatcagcacaccgtcgaatcccatctcgtctctcaggatgtcacgcatcagccatttattcgcactggccgggataccgtttactgtgttgaaggaggtcatgaccagcgctgctcccgcgtcaattcccgctttgtaggctgggagataatactctctcagtgtatgttctgaaagctccactgtattataatcccttcctgcctgggctgcgccatacgccgcaaagtgtttcacacaggcagcgatctgatacggactgctcagatcatccccctgaaaaccttccaccatagcctcggcaaaaaggctgttcaggtaagtgtcctcacctgtggattccatcacacgtccccaccttgcatcccggaccaagtctgccatgggagcaaatgtcacgtgaaggcctgtaaccgcagcctccttcgccgcagcccttgcacatctttttgacagttccggttcaaaagctgcaccctgccccagaggaatgggaaatatggttttcatgccatggatcacatccatcataaaaagcataggaatatgatgaggctgtgtctccatataatttttttggatgtcttttagtttcttcgcccctgcagttcccagaatggatcctgccattcggatatctccctcgttaacgcccagttctcctgcggggcctgtcatgacgctgtccgcatcctcataaaaatcgcctgtaagctgcagcatctggtcaattttttcctgcagtgacatactgtttaacaaatcctgtaactcttcctgtctcatatcttctcaatcctccctttcttcccgccctcatttatcaaaataacttctctctccggttccagggaaatttccgttccccagaccctcaaagtgcctcccggcaccgtggacatcaccctgacttcccggctgtccatggacactgacacactgccgcccgccacaggaactctgcccgaaaaggatgtaagccctcccagatccggacacactgtaaacgtatcataaccgataccggtattctgcacacccagccggtaatttcccaatagatagacagggcttgcactccatgcatgacatagggatttctcataaggatttccatacatggcatagtgttctgccccctgctgctttggatcatatgcctcatacagagtcgtggcccctgtttccagcatacttccgtaataggtgcggatggactgctccagaatatctgtatttccttccatacagtgtacctgattttcataaaatttgaaataaggtgtggtgatctgcggcaccttttcattcagaatcacatgggtataaatatcccttttctgttcctctgtacagggaagaaaaagatatgccagaatatttgtctggcgggtcacaatattctttccggactcataactgtcaataaacacatggtcctgccggtcataaaaacgctcaaaaaccgctttctgcacatcctccgccagcctttgatatcctttgtcgtccccttccaatatctgcaggatctttccaaaacattccatcgcctttgcgtagaggatctgctctgcgcagactgccccggtcttatccatgggtgcccagtcaatgaagatccagtcccccggcttttcccgcataaatccgtcactgtccgttctgcttctgcagaaatccattacatgctccatctggggcctgatctgctccatgaatttccggtccccatatgtacggtaatattcatacagactgatgatccagaaaaaactatagtccataatagtgttaatgtgcaccttaaacggggtcttccctcccagcgcaatcagggttctcctctccagatcccgatccagaaacaagtaccggtttacaaacagacactggtacgcatccgctgcccacacccacctgtccctcttaatgccgtccagaaaaaactctctgcagttcagatggaacgtatatgccgctgtgtcccatacccggttcagaacctcatcgctgcagcaaaagctccctctgtatgtaagaggcaagtattcatactccgcctccacttccgcatttctgtcactgacaaaaatatagcggaatgcatacggttcaaaggaaatatttccctcaacaggctgtctgtcaaaatgtatcacactccattccctgtccagagcctcctccctggattccccgaattgaatatacacttttctgtcactcagcccgaagaatctggttcctgcaaaggtctctctgccaaagtcaaagagcacaccgttttccagtacctctctctttttataatatatcttttcataggaaaaaggaaatacttccggcgttttctccgcctctgtgaacatggaattcgtccccacaggtgcccagtcctggctcatatcatctgccgtccaggtctcatcgctgtttactaaaccctccacataaatacagggaaaggactctttattcgatgtacgtatagtaatttctacagttcccggatctaagtcaatgacacttctgccgccgtattttctgatattttcacctctgtatttgtctccgatttttgccacagtgactgaaaaagttccgcatgcccgaatccgaatgctgcctccctttgtggtcactatctttctgaactgcactacaggctccggtgtgtacattttccacacaaccggctccggatatccatactgctgtctcctactgtgcagtaagagactgtgatatatttcaaaatctccgaatttccaaatccattggctcactccgtcgtcctccttctatctctcaaatgctgatctggcttctgaatggttacgttcaagataacatttttgtttcatttggactacttttttcatgactccctttgtcggttttgtgactttgtaaaaaaataccggttctgtatcataaatgatacagaaccggcgaatatacaccaataccatatattgatctgtaaaagccttgcccctgcaaagttttccatcctgatccctatggaatttgactggcaaactgcagcagctcctcctcatatacatattttgtaagacatccaaccccctgtacgcatgtgcctcctgtcacatttccaaaccggatacactgctccacaggataatcatggtataatccataaataaaaccacttaaaaatgcatcaccggcgcctgtggcgtctacagcctccacatttttcatagatggaatgatagatataccgtctttattcttaagaagacatccatcccggtccagtttaataataacatcactgaaaaattccgacagccggtccgctgccccttctactgtactctcacctgttatttttaaggcttctttctgattgggaacgtaataatccgcaatctgcagatactctctgtatttatcaatagacagatcatcactccaccctgtatcaaacacctgtattgttccttctccctgcagttttctatacacatctaaaaatccctcgtgcatatccaccactttcgcccctttcaggctttcatatatctggtcaaggacctcagaagtgatctctacctcatccctgtaagagacaaaactcctgtcatgctcccaaaccattgtggaggaaagaactaccggcattttattccctttataaaggtttaccagctccacatggtatgcctcaaactcctttctcacgaaatctgaaaagcagtcctccccgatgaatgttacaaccctggaagggatacccaggcgctggagattgatcatggtagcaggaatgcctcctcccagctgcatgtcaaagctcttggaatatatttcttcaccggccactggcatccggctcaatccctgatagagtaaatcaatattggtaaagcctgctcctccaacgaaatccatctatgtccactcctctgtatagtttttgtttgattctatatattgtgaaaccagcttctgtgcaagggagtaggaattcaccagcgggtgcagcatgaggcagtcaactgctttggaacggctgtttgtccttaatgcctgggacgcatagcgctcatagcttttaacccttctgatcagttccatctgcagttctcccggctcgtcaattttgtggggtatatactttccgtctcggatggtgcaagtgatctccaccacatccgtatctctcagtcccggaattgccccctggttcgggacacagaggatcatctcgctctcctgtccgctcaactcggaatacatgtattttagcgcaactccggcatatcctccgctgtctttttcgtaaatatcaaaagaaaatggcggtttcccagtctttattcccgtctcattggccatatatgcattttcacgcataccataccacttttcaaatacacggaggcaattatcgaaatcatgttcgatatccatatgggaaagttcttctgtcataccgcggttcacatccctgataacctcacctctcgtaatacctgctttcaggatattctcaagtgccatttccctataataaaagtaatataaatattcatttaatatacatcccaggtgctttgcaagatctttttcaaaaaaacgcatatccgtcttttggtatacttcaccatcctccagcagtctgggcataatatcctgtcctttaagctttacattactgaaaaaggacagatggttcagtccatagcagtcaccggtaacctcatcctgacttacatggttcaatttagcaaatgcatggagcaggctgctgggagcgtcacagataccataggtaaaatcatatcccaaatcccgcagtgtctgggatactactcccgccggatttgtaaaattgaatattttgacattaggagacgcgtattttcttgccaattcacaatatgtacgcagtgcaggtactgaacgcatagcaaaggaaaatccggcagctcccgtggtctcctgtcccaaaacgcccagatcaagggctattttttcatcccggatacgcatatcgtctccgcccacccgaatggtggtgatgatgtagtccgcatcggtgactgcctccaccggatctgttgtcagtttaaaatcaagttccggtctgatccgcctggagacctgctctgccatcttcccgtagatattcagcttttctgcatcattatccataaataaaacctgtgtgaatcccagtttacctgcactctgtgccaggctttttgccaaaaacatagagcggacacctccgcctcctattactgttatcttcatttatcgtcctctttcctgtttttaataatccgcctcattcatgcggaataaacggttgatgagatagaccaccatgacacctgatatgatcaggataactcccatcatgttggcataaccataattattgtctgtcatggaggttttatatagatatagcggcaggttaagcgtcacatcccccggtcctccatttgtcgtcagatagatcaattcaaattccctcagcatactggtagctgccaggatcacactggttcccatgatcgtccgaataagcggaagccgtatcctgatattcaccgccatctcagaagctccgtctattctcgctgcctcaaccacatcctgtgggatggacaggatcccagccaagatcaggatgatgacaagtcccgtatacaaaagccagctccatgtgacagtaataaatgccgagttaggttcaaaaaaccaattcttagtaaatgcgctgccagtcacttttgtgagaaatgaattgataattccatattttgcattaaacacgtttaaaaatataacaccaagcgcagcagccgaaactacatttggtatcatataaatcgttctgagtatcttccatcctcttttctgccgggataacataaacgcaacaacggttcccaggcccacatgcaccacggactgcagtaaaacccaaatgcctgtatttctcagtgcagtccccatcctggcatcatgaagcgcgtccatataattctgaaaccctacaaatttaaaaatgcctcctgctttccattcaaagaatgaacttccgaataccatgcacatgggcaccagatagattagcccaaacaacagcatacacggaagaaggaagcttgccagcttccacttattcaccttcatctgttatccctccctatgaggcggcataccgccagaggcgatatgccgtattctgctatatgttaatttttgcctgctgcgtctgtcaatgcctgagcaaattgttccggtgtgatctgtccctgtgcaagaagaggatactgtatacttatctcatccaccacatttgcataccataagctctggaaatcattgatacagcgctccgctttgttgccattttccaacacttcattgacaagtggttttacattgtcggattttacattctccgaagcaggagtatcccctgtcatttccagcatcagtctctggctctcatcactggtcatgaatttcacaaattccagtgttgcctccagtgttttttcgtcttttgatgccacgttaaaaccaatcttcccgctgttgtacataacttttccgggatacatagctgtacctactttatccgcaaacccttcctctaccagtgaagtatcataaaaatcgcttatcatccaaggtccgtttgcaatgatggctgtctcacccatgaagaaattactggcagcattctcatatttcccgcccacagcatccggcgtagtatatttctggaacattgtctgaatttttccggcggcatctataaattcgggagtattataatctgtcggaagattggtattcataaacttctcaccttcctctgtctgtccgatcatcgctcccagcataagtgatgtcacccagcctgaatctgctgtgtccatagataacggggtaatacccgctgccatcagtttatcgcactgttcaaaaaattcatcccaggtttctgccggtttctcaattcctgcctgttgaaacaggtctttgttataaaaatatccgataacctgcctggtataaggtatcccatagatcttaccatccctggaattcacatcccagcatacatcggaagactgtttcttccattcctcatccacatagggggtaagatccacaagctggtctttcatggaatcgatcaggttatagcctcccgtggcaaaggcatccggcagcgcattggaggagtacagcaccttcattttatctacatatgcctggtctcctgcaatttcttccacattaactttaatcttatcaccatattcctcgttaaatgcttccatcctgttgttaaaccattccgtatttacactgactcccacccaggatgtgggaaaactgatttctgtcactgcctctgtacctttttcctctttggccggtgcctctttcccactgtctttgtttgaaccacagcctgccattaaggatactgccgttactgccaccgctgataatgcaattgcttttttcattttcataacttgttcctccttataataaattttatattaacctttgatcgaacccgccaccatactggctgtaacctgctcctgcagtataatataaattacaatactggggaggatcaccatggtgagcgctgcaaacattgcggtatagttaaatgaaaactgtgaagtaaaataatttagtgccaacggcagtgtcctgaccttcgtgctttttgtcaatatgagaccaaacataaattcattccaggatgtaaggaattgtaaaatggcacctgtcgccagacccgactttgcaaggggaaagataattgtaaaaaaggtcctgtaaaatcctgccccgtcaatatacgctgcctcttccagctctctgggtatgctttggaaatagcttttgaatataaacaacgatgttggaagtcccaatgctgcatagaccagtatcagcccgcttctcgtatcatacagacccaaccccatcataattttatatataggcatgagcagcgcagaggttggtatgagtaatgacgaagagagcagcagggttatcaatgcatttcctttgaaccggtatctggacaaaacatacgccgccatagaaataatgagcacattcaaaagtgtactgctcaccgcgatcaggacgctgttcccatagaatttaaaaataggtgccagctccagcgcagcccgatagccgcccagcccccagttttccgggagagaaaatgcggaagacaaaatttctttgttcgtcttaaatgatgatatgacgatccagagcagaggacccaatgaaatcaaaaccaggaatcccaggaatagaaatcttatgattccccataacaactgcttccccgatacttttttaccagtcattcatctacctcccgtttcttacatgtgcctcttttcaacagctggtatggcaatgtatactccatattctgattctgttctttttcattcatattgcagaacgtattcagagtccattccaccattttgtcaattggctgatacaaggttgaaagctttggaatcgttcttcccgaaacactgataccgtcaaaaccaagtacagatatgtcatcaggcacacggtatccatggtcatgcagtgctgaaattgctcccatggctgtctcatcgctaaatgcaaagacagccgtaaatttctttcctttctttatcgcattttctgtcaaacgatagccattatcaaatgtcaggtaaccgaattctgtcatctcatccctgtcaagctgtattccgtattcagccaatgcctgctgacatcccataagcctctgaaatcctgagctgaggctgtgagaataatccgataatatgagtatttgcttatggttcagatcaagcagatacttcataccttcatacgcagccgacatatcattgatatgtaccatctcgcatctgctgtcaaaagacgcaccacccagcattaccaccttgatattttttgcctgtatatatctgagcatatctcggtctatatcctcatccagataaataacacctcttacatacaattctttaaaaaataacttgtaaccgtcatcaccgacaaccgttgggagaattaccagtttatacttatattttggcatctgctctatgatttcccgtaatacctcactgaaataccccagacgcaaatgcggaaccagaacaatgatcactccctgctcacttctcttcttggtattcggagtataatgaagctcacgcgctgcttcctcaattttttttgcaagttcatctcccacaacattactccctgaaaaatatcgtgaaacagtcgccggagaaacctgtgcttttttcgcaacatctcgtattgttgctgccatcttatcagtcccctcccactttttagtcaatttaaactatttttttaacttatcagctgttttatggtcaatttaacaataaatctcatactcaaaaaagtcaacgcagtttcatgtgtttcatatttgtttcatcgttttcctgcttttctcatagaaacactccgcagctgcagaaaattttactttcgccatatggccgctccctatatcattaccataatttaccattcccccataaatgcaaaaaagacaatcaaatgctcttactcgagcatttgatcatcttttttatcataacatctttgctcatcaggcaggaagccatataaacaaagatgttatgagttatgaaatttctgcagcgctgccatctaaaagcagtcgacttgaaaccggcgtttattcatggatcttaataaccgccttcacaatatccgccttgttattcatagagaactccatagccttatccgcctcatccagcgggaattcatccgtcacgattcccttcagattgatcttgccgtccgcaactgcctggatggccataggatagatatggcgataacggaacaccgtcttgaatgtcagttccttgtcaagagcgatgctcataggcagagttacctctcctgttctgctgtatcctacaaatacgatggtggagccttttctggccatgagaattgcctgtctggaggtcacttctgcccctgcagtctcgatcaccagatctgttcctctgccgccggtcagctcttttactttggctaccacgtcctctttcatgccgttgataacacctgtggcacccagctccatagctttttccagacgtttgtccatcacgtccacaacgtaaacttcactgacacctctggcttttaatgccatcatggaaaccaggccgatacagcctgcgcccataacaactgccttctgtcccaaatgtgcatctccctggatcgcggcgtggaatccaactgccagaggctcgatcagagcgccctccagagtgcttacattgtccggcagcttgaagcagagatttgcctcatgtgccacgtactcctggaacacaccgtcaaccggcggagtcgcgaagaacaccacatccgggcagagattatatttgccttccttgcagaattcacactgtccacaggtctttcccggctccaaagccacacggtctcctacctgcagatgcttaacatccttacccacttccactacaacaccgcccggctcatggcccagtacaaaaggcggttttaccacgtaatctccgatagctcccgtctcataatagtgcaggtcagaaccgcagattcccacataatccagctttaccaaaacctcgtcatcctttggctgcgggatgggcctttcttcaaaatccatcttctggatatccgtcattattgctactttcatcatgccttccatctcttgttttcctcctcttatgaatgtgcattatgtgacttcattataagccagaaacacatatatcacaagtgaaattcatgtctttttactacaaaattctttgaattttatatctcatattcgtccttgactaaaaaaagaggcagggataaaaccggaaatcccggtcttatctctgccccaaagcggaggcgaaataaattagtgatggaacagacgaatgcctgtaaatgccatcgccatgttgtacttattgcagcactcaatgactgcatcatcgcgtacggaaccacccggctctgcgatgtattttacgccgctcttgtaagcgcgctcgatattgtctgagaacgggaagaaggcatcagagcctaatgtgacatctgtcagtttgtccagccatgcgcgtttttcctcacgtgtgaacacttccggtttctctttgaaaattttttcccatgctccgtcagccagaacatccatatattcctcaccgatgtagacatcaatggcattgtctctgtcagcgcggcggataccgtcgataaacggcagatccagtaccttcgggcactgtctcagccaccagttgtcagctttctgacctgccagacgggtacagtgtacacgtgactgctggcctgcaccgataccgatcgcctgtccgtcttttacgaaacagactgagtttgactgtgtatatttcagtgtgatcagagaaatttttaaatccatcaatgcgtttgccggaatctctttattctctgtcacaacattggaaagcagttcatcgtcaatagaaagctcctgtcttccctgctcaaatgtgatgccgaatacctctttatgctccaacggagccggctgataatccggatcgatcttgatcacattgtagttgccgtttttcttctgtttcaggatttccagtgcctcatctgtatatccgggagcgataacaccgtcggaaacctctctcttgatcagcatcgctgtatctttatcacatacatcagacagggaaataaaatcaccgaaagaagacattctgtcagcgccccttgccctggcataggcacatgccagcggtgataattcacccatatcatctacccagtaaatctttttcagtacatctgacatgggaagtccaactgcagcacctgccggtgacacgtgtttaaaggaagctgccgccggaagaccggtcgcctttttcagttccttcaccagctgccagccgtttaatgcatcaaggaaattaatatatcccggtttaccgctcagaacttcaataggaagctcgctgccatcagccacatagattctggaaggtttctggttcggattacatccgtactttaacgctaattctttcattttcccattctcctttatgcttttcaattatttatttttatttacgatccttgtctcatacttaccggttgcaatatcaataaaacgaacaaacagagacactttgttgtcttcattcaggctctcccaaacattctcagcaaatgcatcaatatcattgggaattcccaccagctttggttctccctcaaagcttggcagcggattgccgtcatgcatataagtgtgtataaaatgtccctccccggctgccgggttctcataagtaaatgtataacggcagcagctctcgggattgccgttattactcttcaaaatggacatagcataatggtatgtgccggcttccacctgcataataccggaaatccttggtgtgtaattggggccgtccggctcaaattcacgcgttctcagggactgctcaaaagtgatgcccttttccattccttcatagacagtatctgtctggtcaccgttggtcacgatcgtcttattgccgatcacacgcaccggtgcatatatgatcaaactgggatcagtcagcttagacgggtcaaatgcctgggtgcggataccctctccctcttccacgaacacacggtttctgctgttcccgcttcttcccatgataaaatatgcagtcactgcatttgttccatcctcagacttaccaataacaattcccctgccagggtacgcattttctctcaattcattttcaagtgataacattttcatgaattccttctccttctcattttgaccatgatcatcagctgccaatccatcggcaactttaccgtaataaatgtaacgtaactgttcactaccttcgcaattacaataaaacaacaaaaaaagcccacactctgaacatacttgcccagacggtcggcttcctacgcttatactccctgtggttcattccacttccgtcagtcatataagcaatttaaacattatcatgtaatctttctcttgtcaacgcttttttgacatttttcatcaaaaaataaattgcaaaaaaatcaccagcttattcatacggccctagtaacgtctcttgagtattttaaactaagcatcagaaccgacggcagactccagaaacagcataataaatcagccctccaggtgtccgccgcggtgatcagtctgacactacaagatcacagcaccggcataatcggtgttgttcacccttcacatacctgaaaaatgtaaaacttcaaataataagattcctctgccgcccaaagaatgggatgatctgctgcctgtgtccgatattccacctgccgcagcctcttgtgcacattcctggccgcctgcccaatggtctgggtaaacatctcataagacataaaatgtgagcaggaacaagtggccaaaaatcctccgtccttcaccagcttcatagcccgcagattgatctcccgatagcccttcaccgcgttcttaacagaattccgggatttggtaaatgccggcggatcaagtatcacaacatcgaacttctccccctcttcttccagtctgggaagcagttcaaacacatcttcacacacgaatttcacagtacctgacaggccgttcagcttggcattttccctagcctgctccaccgcaagctgggaagcgtccacgcccagcacactctttgctcccgcgacccccgcgttcagcgcaaatgatcctgtatgtgtaaaacaatccagtacctttgcatccctgcataatttctggatggccagcctgttatatttctggtccaggaaaaatccggtcttctggccgtcctccacatctaccagatatctcactccattttcacagatctccaccttggtatcgaaaggctccccaataaaccctttaaaaggctccatgccttcctgccttctcaccttagcatcgctccgctcgtaaacaccgcgtatcaccacaccgtcctgtgccatctcttccttcaaaagctccagaatcttcattttcatcctgtcaattccaagagccagtgactgcacaactaaaacatcggaaaatttatccacaacaagtcccggcagaaagtccgcctcaccgaagatcacacggcagctgctggtatccactgtcttttttctgtactcccaggcgtctcttacccgttttctcagaaactcctcatcaatctcctgctctgactttcttgtcatcatacgtatcctgatcttggagttggtattgataaaccctcttcccaggggatatccgtcaaaatcgtggaccatcaccatatccccgttctcaaagcttcccaggatactggccacttcattgtcatatatccaggggcctccagctttcagggaacggccctctccttttttcagtgtcgcaattgccagactcatgtgtcttcctccatttttctattttttctgtcccagcaaaatataagcgattccgcagaaaagccctcctaccgggaataatacccaactgatctgccaggcattctgtaaaaaactccagagcagataaatcgctgttgtcacgatcatgatacaggcagaccattttgctgccagcggcatatggctttcctcgtccagtatacgctgctgctccggggtcaggcgctcacggtacagcggatcatgctctttgttgtactcctctatattatacttgcttttttccatgccggaatggaccagaagcatcacacccgcgctgataagcaggagcattaagaagctgtagaaagcagatgcctccactcccgcaggggagggcaggaacttctgcaactcatctactactatactcatcaaaaggatcccgatccccgcagccattttaatggggaagctgcggtccaatgactccttctcctcctctgtgtaaaagggcagtatataggggtgtctttttgtaaaatcactgtgccggattcccgccactacaaaagtcaaaaccgccacaatgagaaacgggaacatgacaatatcctgcagggctttccaaagtccattcattccttccaggagagtggaaaaagctcctcctatgatcagaattcccacaccggcggtgacagcctttccaaatcttttcatatgttcttcatattgggcggaatcctccacaacctctgcctgggcgtctttgcgcagcagagtgtccatactgcaggaaaacatatcacagagctgcatgatcttttccatctccggataggatgtgcctgcctcccatttagaaattgtctgtctggacacctccatcctctccgcaagctgttcctgtgtgatttcctcccgcttcctgtaatactgtaaattctctccaaaactcataatgatttcctccatttctcatatctgattttggaatcattatagaattgcgtccatgtaaactctaccaatttcctgttgcttttgaggaaatccatgtaaacttacggttgcaccccgctgtttaagcgggttctcacatttttccactggggatagaacgcatccatatatccataaaaaattttgttgtgtcctctctccaaaagatggaccagttcatgggtaaccacatattccagacattccctggggtattctcccagccagacattaagccatatcctctttttttccacattgcaggttccccatcttgtcttcatatcccgcagacgccactcctctgcgtggacgccggtcttcttttcacattcctgtatgacctggggaaggattttttccagacgctttctgcactcctgctttttctcctcacgctccccgcctttatatagctcccaggggggctggctctgccccgttccctgccgcttttcttctatccaatccattctctccaggataaatcttctgatatcccgctccggcattctaaaaggtgcggatacccggacgcttccgtccccgcccacacgcagatacatgttgcggatcgcttttttggtcacctggatatcaaggccgttctccgtcagataatacgtctttgtcatctttgcccgttttccggaagtctttaccacgccagaacctccggtccgttctctgtcaccagcaccatgatctcccactgggcagagggcagcccgtcttctgtatagaccgtccagccgtcatcctcgtcaatgaagatttcacttgcccccatattcaccattggctctatggtaaacatcaatcccggcgccatcaccattcctgttccggctctgccaatataccccacccagggatcttcatggaactccaggccaataccgtggcctccaatctccttcaccacactgtatccgtttttctgcgcatgctcatggactgcctgactcatatcacccaaaaatccccagggctttacctgttccagtcctttctccacacattcctttgtaacctgcacaagacgctctttttcctgccccacgtcgccgatacagaacatcctggaggaatcagagtaatacccgttcaggatcgtggaaacatccacattgataatatccccctccatgagtacaatctcctccgacggaatgccatggcagacctggttattgatggatgtgcagacactgttcgggaacccttcataattgagtggtgccggcactgctcctgcttttgtagtgatatcatatacccagcggtcaatttctgctgtgcatatgccctctttgatatgttctgcaacgtaatccagtatggcaacattgatctccgcgctttttttgatccctgcgatctgttccgcagtcttaatgatcccgcgctttggaacgatccgtccctgagcctgcagatggttcagcttatcatcaaacggtccatggcattttttatatttttttccgctgccgcaccagcacgcgtcatttcttcctaaatgattcaattgttttacttcctttcccgaaaaatctccctcaatttttctgtaacagccaaagccagcgctctgtgcccctccggatccagatggacagaatcctctaaacatggcattgtcactttggccgcatccaaaaagacacagccctgccgcgcagcggcctctctgtaatagcaggccagctcgcctgacatcttcactgcccgctcaccgccaaacataggtgcgcatctgtgatgtacgatctcttccctgatcctcaaaggtgagatcagcagaatctccggtacggtttcctggttttctcgaaaatacatctttatggttttcaccagggtctctgcgcctgctgccacatcagcagcagtcagggaaaacctctgtttcatatcattggtgcccagcatcagcaccaccacatccaaagggctgtggctttccagacagggaatcaggtatttcagaccgtttttcatcccttcaacaggatcatcccagactgttgtccttccattctgcccttcctctatgatccgtatctgttcctccttcagggcctcctgtaccagactggtccagcgcacgccccaggggaagcgatttccggtcacaccgtcatatccatgggtattggaatccccgtagcataatacattcttcatctcttatttctccattgcctcatattcttctcttgtaatgcaaaagagatcatgcggcatatcaattccatagtaatgctttacaaaggaacctcttatcttcatgccgtttctctttgccacattccgggatgccgtattgttatccctgataatggaatagacttccccggcatttaagatctcaaaggcgtaatctctgcaggccgctgccgcctccgcagcatagccctgatgccagaattctttacagaacaaatatccgacctccagcacctgttctcctctgcagtcctgcatcgtaagaccgcactggcctataaattcccctgtctcttttaagataactgcccacaggccgaaaccatactgcctgtaacgttcaagctgcctctccagccactcctttgcctctcgatcggaaaatgcatgggcataggcatacataacttccggatcctgcagcattttattcagggagtcctgatcttccctgcacatttttctcagcataagacgttttgtctcaagcacagccttttccatcatcctgtctccttctgatatgcgatcctctgtgttccgtctttcatatatacaataccgcagcgtatgaaaccgtttatctcaaatactctctgcatgggtatattatcctggtgtgtatctccccgcatgttgtcacaccgggccagacaccactgtacacaaaaggatgccacgcccttttttcttccggcagaagctattctgtgcaggaatccgtaaggcttatcattcagccagtacccctgctctatcctttggtaattgggctcttctcccacatcaaacatgaaaacgccttccatcccgtccaaagactcacagatatataaaacaccgcggtttacatctgtctccacatcttcccgcgccgggtagccgtttccccactgtccgggatttccgttctcagccatgaactttcttgcccgttcataaagggacaaggcttcctctatatccttttcctcagctctgcgaatatataatcctgtatccatctccgtatactcctccccggtactatgctctgcggctgtgatccgcctctgttgtatctccgcaaaaagactatgcacagtataccacggttttttctgtttttccatatgacccacaggatttataaaggatcctattgtacgaaaccaatataattatctgataacataagaattttcaatcatttttacagttataaaaataaatattgataaattttcattttatttattgacaaatcaatacctgactgctataatgaattcataaacaaagagagaacaaaataaaaacagaaaggactgataccaccgaaaacgtaaaggaacatccattaatttaaaagaaaggaaggtacggaccaccaagaacttaacgatttaacccataataaaacaaggaaggtaaagtcccatggacacatcagaataaaagagtcattcggaatgtaaacttcggatgactctttcctattgcgtaaatacgttctgtatctcttctatcaccaaaaagaaacccttcaggaatcctcccaaagggttttctcatgtcctacatctccatgcttaatgtgcaaaaggcgaaagctccagccggataaaatatccctggtcatgagagcataccgggcatttcttcggcgcttctttgccccagtgaatataaccgcatttcagacagatccaccctgtctccacatctgacacaaaaagcttcttctcctccagatactgagcaaactttccgaagcggtctccatggaatttttcgatatccgctatcatatgaaaggaattggcgatctgcgtaaatccttcctcttttgccttatctccgaaattcttatacacatcatcatgctcttcgtactcattgtgctgtgccatgcgcagaagcttatccatgtcaggcgagatatccaccggataaccgccgtcgatctgaatcgtttctcctgccatctcttttaaatgctgataaaaaatgtatgcatgctggcgctcctggtctgctgtatagttgaagacagcctccacaacatgcagatgttcctttttcgcctgtgctgctgcgaaggtgtagcggttcctggcctggctctcacctgcaaaggcgcgcatcaggttttcttttgttacgctttctctaaaatctacagacatacaattgcctcctggtatttattttccatgttattttttccagaagcgacaattttatacctggatctctcagtcttatccgatggtatgatagagtgcggtcagtatttccagaatctgttccctggtaaaacggctgctgtccagacacaggtcatatcccttcatgctgccccacttctcatctgtataattgttatagtaatattttctctgcttatctactttcttgataagctgttccgctcctctttcatcccagactgtccgtgcccgtatggttttgatcctggtctccataggtgcatagataaaaacacttctgcagtccggtttatctctgagaatgtagtttgcacaccgccctacgatcacacagtcttcgtttcgggcagcctcttcaatgatttccgcctgcgcattgaacagcacatcattgagaggttcatagtgaaactgacgctccatggccatattctcatcaaaggaataacgccaggggctttcccgcttctcatccacttcttccagtttctcttttggaatattctttttctgggctgcaagggtgatcaaatccttgtcataatatttgatgcccagatgctctgccagatcctgcgcgatttttcttccgttgcttccaaattctctgccaagtgctatcactttacccataacataccatccttccccattcacctggcgtccgcatcgttcccatacttcagaacgacccgtccgcattttcatgctgccgcaggtttcagcctactgcttttgcaaaaactaaagactgaactcttatattgattatactaaattttcacaatctttacaacttttcttaacaactttttagcaggcgcataaaaaacacctcgcgggacagtggctgtgaatcgtaactaagaattttccttactttccagtgaaatgccactctgtgccgggctgtctacacagttccccatgtagtcgaacctggaaccgtgacaggggcattcaaaacatttttcatccggattccattcaagctggcatccaagatggggacatttggcagataccaaatagatctctccctcctcatctctgtatgctcccactttttctccgtcatagttaacaatgccgccgtgtcctgggggaagttcatccagatcacttcttccctgtgtaaaaatccttctgctcaaatccttcactgcatggataccatccttgcagaaattttccgcggaggccttgggcgtaaagcgctgcggcgaaaatatgccgaacactttctcctcctcatcccccagaatactctctgttatcataccggctgctgccatggaagaactcattccccactttccatatcctgtagcagcataccagtcaggggtatccgcagagaacctgccaatgtagggaatctggtccacaggcatacagtcctgtgctgaccagtgataccgcacccggcttcccggaaagaactcttctgcttttcttttcagcaggtcgtactttccccctgcgcggttttctcctgtgcggtggccgcctccgccaaagagcagatactctcctgcgcttctgaaagaccaggcgttattgctgtctatgcccaggtacatcccttcaggcttcaaggcattttcaagccccagcacataactgcgctcctgatgcatccgcatgaaataataccccggcacattgagaaaaggatagtggcaggcaaagacgattttctttgccctgacacttcccttttccgtgacaagccggtctccctctgcctgcagtacccttgaatgttcatagactgtcagcccccgaatgactgatcccagaaaaagaagaggatgaaacctggcctgatcgtcaaagcgcacagcacctgccacttcaaaaggaagctccgtatccctggtaaaaacagcatcaatcccaagccccgcagcactttgggcctcctcctttaaaagctcaggtgattccaatgtatataaatacgccgggcatctgacaaatccgcagtcgatctgtctgtcctgtactattttctcgtacctgtctattgccttctggttttcccggctgtatttttctgctgcctccttcccgtggagggatatgatcttctgatagatcactccgtgctgggaggtgatcttggctgttgtcctccctgtctgaccacctccgatccggtctgcttccagcacgatcacctgcagtccctgttctttaagaaaatatgctgtcagtatcccggtcattcctcctcccatcacagccacatccgctgtgatatcccgagtcagctccgggaatgactgtatttttgtttcatccatccataaactatccatagcagcctccgttttatatattcctgtccttagaatgctcccgatcctttcagggtatacaaaaattgccgttttcctcttgacagactgctgctttggcataaaaaaacaggggccgctgtttttatgcagtccctgtcaaatatttcatggcacactttcctgtctgtgtcatgcttcctcgatcaccatctcatcaccgactttgatcctgccgccgtgaagaacttttgtaaatacaccttctcttggcataatgcagtcacccatcttctgaaagatctcacagccgtgatgacattccttcccgatctgtgtcagttccagcaccacgtcgttgcagcggaatcttgtcccaataggcaggttcttaaagtcaaacccgctgactaccagattctcaccaaaggcgccatccgctacttcagcaccgcggttcctgaaatcctcaatcttttcatagctgagaaggcttacctgacggtgccattttccggcgtgcgcatctttctctatgccaaaatcttcaataaattcagcctcctgaatgttttttttctgagttcccttcttctcgctgatacagacagccagtacctttcccattgcttcatcctccaatttctgacatctttttattttccagaccttcctcccggtcctctccaaagcggtggcttctgggcttctcaaatatggtcttctcagccacaatgccgatttgttcatctgagcttccgtccctgagcaggctgcgcatatctgctccatgcgaaaactgcagacacggttttaaaaatccctccgaagtgagccgcacccgattgcagtcttcacagaacttatgggaaatggcactgataaagccgatttttcctttaaatccctccaactgcatatatgtactgggaccgttgccgaatcttccgcttaaggaatccgctttgccgtaagcaccctccagcagatggcgcacatggtcttcggtctcttccccgcagtatttcctgccgtatcctataggcatcatttcaataaagcgcacatccaccggtctgtcctttgcaaggcccgcgatgggtatccactggtcctcattcacaccgtggagaaggacacagttcaccttcacacgcacaccgggaaactgaagagccttatccatcccctccaataccctgtcaagcccttttctccttgttatcttctcaaacatatcctctgtaagagcatcaaggctgatattaaccgcatcgattcccgcccgggccaaatcttgtatctgttcccccagcagtatcccattggtggtaagagtcacattgtcgataccgggtatgctttttatcatacttaccagctctgccgcattctttcgcaccagaggctccccgccggtgatctttaccttgcagatgccttttggggccaaaatgcggcacagcctggtaatctcgtcataggttaggatatcactgtgctccacctgttcgatcccgccttccggcatacaatacatgcagcgaagattacagcggtctgttatagatatgcggatatattcaatattccgtctgtactgatccaacataattttatcttcctgtgtaactgttcagccttcacggacctgctgcacagtcaccttcctgttttcttaatatatttgtaactttcagtctccttacagtgatgggtcaaaacccatatggaacagttacatatatttacagtatacctcaaaatcactgaaattgcacctggaattttactcaaatatgacattttacacaaaatgccaaaggctggtctttttcagcattcctcacaattcagtttaaaaaagccctggggacaaccacatacggaacacctgaccggcgcacagtcaccgtaagccagatgaccgcagttcatgcagatccacaccctgtctatctctttgcagaaaacacggttggtcagaatatcccgggacaattgttcaaaacggtagtcgtggtgcctttcgatctgccccacctctctgaaaagcctggcaattccattaaagccctcctgttccgcttttttggcgaaatcctcatacatctctgaccattcttttttctcatcctcgtgggcattttccagatttctgctggtctccggcaaccgtcctccgttcagcaggttcagccagatctccgcatgatgctcctcatttcccgatgtctcctcaaaaatttccgctatgtctatatagccctcaattctggcccgttttgcgtaaacacggtattttccgctggctttcaattctccttcgtaggccttaatcagattcctaaaggtttcactctctcttaattccatcttctctccgctgtttccggctttacactattctatgtacagcgggaagatttctttcctctcaccaggtcataactttcctctatcattctgcctatctccttttccggtatggagccgtctaaaatgacagagttccagtgttctttattcaagtgataggcaggaagcacagatgcatacgtcctgcgccagaaatcccgccactgggggtctgtctttaaattcacccagatatttccctcacgctcaaagatccaggcaaatatttttctgctgtctttcatccggatcaccgtccagttttggtcgtgaaacggatagtcctcaaacacatccggcattttcagacaataggaaatcgcttcctctctggtcctcatattggcctcctttcttttttacacaataccagtatacaggattccatatatgccgtcaaattgttcatttttcacccattgacagaattccatttgtgtgttatgctataaaacaattaaaaaagcattttgataaatgcggtgacggggaggagtacatacccagccggctttcagagagaagatgtgtggtgcgaatcttcagctaggaagtatggaagtagcccctaagcagtgagacgaacgaagattcttgatatctttcagtagacctcaacgtccctttcccacgttacagggaaaacagtatcgatttttttatccgtactggcaaagcgcaggatttttcctgaaatcaggtggtaccacggatgacttatccgccctgaactgagaactcagttcagggcgtttttcattttcaaaccatctaaaaatgagttaaaggaggattttgtccatgacaggaaatgaattatttgtaaaagcactgcagaaagagggcattgattatctattcgcatatcccggcggctacgccatcgatatttttgatgagctgtacaaacaggattccatccaggtgatactcccccgccacgagcagggtttgatccacgctgcagacggctacgccagagcaaccggacgcaccggtgtctgcctggtaacaagcggcccgggagccaccaatctggtaaccggtatcgccacagccaattatgacagtgttcccctggtatgctttaccggccaggttcccacaaacctcattggaaatgacgcgttccaggaggtagatattgtagggatcacccgcggtatctgcaaatacgctgtgaccgtgcgcgaccgcaaggacctgggccgtattattaaagaagccttctacattgccagcaccggcaaaaaagggcctgttgtgatcgatcttccaaaagatatcatgctgttggagggggatgactactatcccaaagaagtacacatccggggctacaagcccagcagcggcgtacacatgggacagttaaaaaaggccatggctctgctgaaagaagcccaaaagtccctgtttctcatgggcggcggcgtgaatatcggaagggcaaatgagacagcgctgacccttgcggagaccaccagagttccggtcatcactaccattatgggcaaaggttccatacctaccagccacgaactctatgttggcaatgtaggaatgcacggctgctatgccgccaatcgtgccatcagtgagtgcgacctgctcttctccatcggcacccgttttaatgaccgtatcaccggaaaaatagatgaatttgccaagaacgccaagattgtccatgtggacatagacgcggcctccatctccaggaacatccaggtggatatccccatagtggcagatgcccgggaagccatggaagccatgctgaaacatatcaagtgctgcgagcatagggagtggctggatgaaatcgctgactggaagaaggagcatcctctggatatggaccagaataaaggcatcacacctcagaagatcgtacagtgcattaacgaacagtttgaggagggtatctttgtcacagacgtaggccagcatcagatgtgggtaacacaatatctggaaatggatgaaaagaaacagcttctcacctccggcggcctgggcaccatgggctatggttttccggcatccctgggcgccaaatttgcgtatccggggaaacctgtggtatgtgtttccggtgacggaggaatgcagatgaacatccaggaaatggcaaccgccgtagcatacggccttccggtcatcatttgtatcttcaacaacagttatctgggcatggtacgccagtggcagcagcttttctatgataaacgctactcctccacctgtacacgccgcagaaagacctgcagcgccaactgcaaaggccccggaaaggactgcccggaatacacacccaactttgtaaagctggcagagagttatggcgcatacggtatgcgcgtggagaaagaggaagatatggcccgggccttccagtttgcaaaaggcaacacagacgcccccaccattctggaatttatcattgacagcgatgaactggttctgcctatggtacagggcggaaaaccactgcataacatgatcttggactgctaggaggagaaagaatatgaagaaaagatggatttccttatatgtagaaaatgaaatcggtgtgctggcaaagatcgcaggcctgttctccggaaaatcatacaacctcacaagcctcacagtgggcaccacagaagatcccactgtgtccagaatgacgataagcgtagaaagcgatgacgccacctttgagcagattaaaaaacagctgaaccgcagcgtggaggtgatcgaggtgatcgacttcaccaattcccgtatccatagaaaagaagttctgtacattaagatcaaagactgcgatgaagctgtaaagaccgaagttttccgtatcgcaaccattttccatctgtctgtagttgactatgggaagacagagatgctcctggaaagccttcagacggagaaacgcaatgacgagatcatttcctacttctccaattattttaagcatatcgaagtggtacgcggaggaagtgtggcgatcaagggcgtaagcattcaagacaaataatatcagagatgctattacagccatgtttcacttaagatccccccttaaacggtctgtctgacaaagggtacatcttaacagaaacatggctgcttttttatggttctattctattgtttattctattgttctgtcttctattttttgttttctatttttctgtttttatttttctgttttctatttttctaatttcaattgttctgtttttcactgtcatctatgctgccgtcccgggcgttttccaattctctttttaaatccgtaatatcatggcaggtgagaagaactgccttttcccctttccactctataaaacacgcatctgcagatgtccagatatgaaaaaacggattataaacctgccggacgcagcggggatgttcgctgtccatctctttgagcgcacaaaaatcgcagggtgtatcccggtaaaagaaagccttgtgacaggtaatgccaagctttgcctccggcacccactcttttgttttccggttgatgtacagcatctcttttgtatccgggcgtatcacgtatacccaggagctttgattgtcaagaatcgcttccagtgacgccgcattctgtattgccttatcctgtgcccggagtttcagtaagaatgtgctcagtatttccgcgatgaagaccagtgcgttcacctgctcctgtgtccagtagcggttgacacggcactcatcaaatccgacaaaacctttgaactgtcctttgtcatagatggcacactgcagcagggatttaattccctgaggctccagcgttgccctctgctgtggtgtcagcccatcaatatcacggcagtaaaacacgccgctctcattaaagttgctttgatatccgccctccagatcattggcataaggcacatgctgaagattctctatctcgggcttaacgccttcattgcaccattcatatgtatttctacaatatttttcgtcctcttcatcctcaaatatataaacgcggctcacatcaaactggcggcctactacttccagtatggcattcactgccgtgtccagatttgaggatttatacaagatcctgaacacatactcaaacagccgcagttcaccactactgtccccttcctcatcagaatctatccgggtattggctgtactgttgagttgtatgggaaactcctctgaggtcaggtttttatctgctacacagtatctgttcttcccctggttcttggcccgatataacgcctggtcagcacgcttaaaaagttcattataggtctgtccgcagtccgggaaaacagctatgccaatactgcaggaaagctccacatccgtcagctcctgcactgccatctctccaatagccttcatgacctgatacgctttttgctctgccagagaagcatccggtatctgcccgagaaaaactaaaaattcatctccgcctatacggcctacaatgtcttcgctgcggaactgcttctgaatggtgtgggcaacttctgagagcagggcatctccaaagaggtggcccatggtatcattcatatgcttgaaattgtccaggtcaatgatcatcagcgctgcctttttccccggcgcgctgtcagacaggactgtctggatataatcctgacttgttcccttgttgtacaattttgtaagcatatcacgctgtgcccgttccatgagattctgagcttttttcttttccgcatctatatccagaatggctcccacggcacgaaccacccgcccggctttgtctgtcacacccgttatccttatacggcaccagacagccttttgttccccgtttacaatacggacctccccctcagcgtaatgttccccgctgcggattcggaccaaaagtttagaaaagatcatctggtcatccgaataaatatacggcgcccgccagaaaaggcggctgacctgctgtgtgatcggagtacaaccgaattttttctcccagttgttagaaaaaatcatggtgtcagcatcgatatcccattcaaaaagaatatccgtggtctgatccattatgatctgatgcctctccaaagaaatccgcagattctcttctatctccttgctccgtgtcacatccacgagcacacaacagaaatattccccatcctcttcatcacggatcagatgccctttatcaagaacccatatagtgcacccatccttgcgtgtcatccggtattccagctctttgtctggcccaagggcagtctgtctgagtgcctccgccaaagcaccctgccggtctcttgggtctatcatttcccaaaagctgttattaaacttttcctctatctcctgcttggtatatcccagcatggataaaaatcctttgttcatctgcagaagagtaagtttctcgtcaaatcggcaggaaaacattccaccgggaatattatcacttaatatctgcagattatggccgccttctccttccggcagtgacacaatattcttttcactcttcatatcgcccatatggctcctatttattgttccctgtatccatttgatatctgaaagtacagaaacgcactgtttattttctatcattctatcaaatgccttgtatttatgcaaggaacaaaaagaggaaaaagtctataatggcaatattctgtaatgattctttttttcacatccacccacatgcccacgcgattgggcatattacaacagaggcgagaatatagactgccccgataataaaaatcggcactccaataaaggtacagagcagtgacaggcacggatgcctccgtgtaaaattggctgccgcagtatcaaactcacactctgttctttggatcgactctctgatatgtgtcataactattcctcctatggcatttatcctatcaccagccgcattaaaacggtaaaagtgataggggaatcgaataaaaataccataaaaaggctgtcatatccctgcttctctcctgctctttccaacaaatggcgaaaaagtccttgcaatccgaaaaaaatctgttataataatatcgtatcagagatgattgctatattttaataagacatggacggattcccgagtggccaaagggggcagactgtaaatctgttgcaaattgcttcggtggttcgaatccaccaccgtccattttatcggataggttcgcctatccgatatcttttgccgcagtggcggaactggcagacgcccgggacttaaaatcccgtgggtagtgatacccgtaccggttcgattccggtctgcggcattagtaaaaagcagaggaaacgttgatcattcagcgtttccttattttttgtcaaaaatggcggggcttgtgaaaactgagcatcatgcaggaaagccggctgccggaataagaagtaatattctattttctacaggcagattttcctcctgcgcttgacatacaacgacatgtgctgttataaataaatcagaaccggaagtctcagcaaggactttcagcctatagacttttcttcacgcactcgttgaccgtattgatagcagccatagataagaagggaattataatgaaaaaaaaagaagaagaaaaatcacctgtctcccattagagtctcttttattatgatcctttttgctatgtgcctcgctatgaatgtgttcctctgtagctctaacgatctttatggaccattagatgagacaaccgcaattgatacatgggcagcctcagaaagtaccgttgtcaatggagacgggaatattactgcccatctcaggacttcatttctgaacagaaataattcttataatgaaacgataacgaaggagatctgtacatctcctataattgcagttatatcaaagggtttccccttgtttcttttccttgttatagcttttcttttttcctttctgaccttatttatattattgcctgacggatggacattaattaatctgaaagtacgtctggacaattgagtcaactccttttcaaatcatggacaaaataaaatatttgccgctataagactcctatatggcaggtgttatggtggtgataagtcatttttgggatcaaacaatggcttcctttttgtatgcaaacaggcagcggatatgaaccgcatgcttattacgagagtgaagcaaagctgagattgaaacggaggaatacaattgaaaaaaagatatataaattatttctcattctaatggtgagcctgtccctgtcttcaggccctgcagttcaaaatgagatacgaaaggtacttgaaactctatcgggaacaggtgatgcgcagattcaagaacttgatgaagacgaagcggaagaaataaaaaagaagaaaaagcgctaaattatttcctaattatataagggccggctcacagataaatgaaccggcccttatatgcttttatttacttcttctgtctctgtctacaacacattttattaccatagccccgtgtgagggaactctcatccgcacaacaccgcccttacagacgtggatcttcttaatgagactgtatccaaaatcaccagtcaccatgagctgtttgaaatgtgcctccctgcttctggatatgccaagctcccagacagacagctctaccagcttggtctggtaactgttgttcacagccaccactgttttttccctatccgtaaatctgccgtaacacaaaagctgataatcatttgccaggaactttaaggaaccctctatcagttcacggttttccttgtgtatggcgatcatgtctctgtggaactggatcagttcccggtcttctctgccccagggatacgttctccggttatccgggtcagtgaatccacacagtccggcctcatctccgtaatagatcgtaggagcaccaggccacgtcatctgcatgaccacagcttccctgaaaatcgccttgtttatctcctgccctgccgcctcggaacccatatgcgccactcgacccaccttgtggtttgtccttgtcaagaaacgggaatggtcatggttggacagctcattcatggctgtcatcagcgacggcgcataaaaacttgccatatggtactgcatggcactgataaagcagtcactgttgccaaacatgccctcactgtactcgtcactgtgcttttccatcccggtcagaaaccaggtaaccggctccataaaggcgtcatagttcataacagtatcccactggtcaccttggagccaggattttgcctccccgtaatgctcggccagaataatggcctccgggttggcctccttcacatttcttcggaaatcccgccagaactgatggttgtattcattgctgtgccccaaatcagcagccacatccagacgccatccatccacattgtagggcggtgacacccactttctggcaatcttcataatatattcatacagcatgggggagtcctcgtagttcagcttcggcaaggtatcatgcccccaccatccgtcataaaactgattatacggccaatcatattcattgtggaaacggaaaaacgtgcggtagggactgtccccggtaatatacgcacccttctcatatccctcctgatactcatagatccgctccctgtcaagccatttattaaaagagccgcagtgattgaacacaccatccaggatcaccttcatgccccttttatgcacttcctccacaaactccgcaaagaatttattgctggcttccagattctcgtaatcggtcactctcttgatgtatttggatgcatgggcattgtccttgtcgccccagtttaagggattcccgccgtcactgacaattttcccgtaatgaggatcaatgtaatcatagtcctggctgtcatacttgtggttggagggcgagacaaatataggattgaaatagatcacatccacacccagtccctgcaggtaatccagcttatcccaaacaccctgaagatctccgccgtagaaatcacgcacatccatagcctgaggccatcggtaccagtcctctactctctggacatgttcatcaatatagcagtattcccctgtcaccacatcatttgacgcgtccccattacagaaacgatccacaaatatctggtacataaccgccccttttgcccattccggggtcttgaatccaggtacaatgccaaaggaataatggggatcgatctcccgcaccacacccatccgattgtaaaaacaacttaatttgcctgtatatatctcaaaataatacctgactgtttcagtaccaagaggaatgttggcttcataataatcaaaaccatccctggagtcagccaggtccatcacttttttcttatcttcgtataccagatagaccaaatccacattatttttcttagtgcggattctgacattcacaacgtctcccggctccggctcaaaaggtgtcctgtaattttctgtctcatcactgaacaccgcacgtttattgaaagcaggacgcatgtttgtcacatactcctgaattttctgtgcattcttcatatattcgtaattcataatgcatcctctccatcattcagtcgaaaaagtcctgtagttctgctttttctgaattactgtaactatacaatttccccatagttacgaattactaatcaatgctggtcttgggtatacttacccatcattaatctattttatcccacccttacttcatatacaactattttttgaaaacgaatacttttatgcaaaaaatgacactttttgtacaaatctttccataaaagtcgaatatttacgctctgccttctataaagtaaaagagacagtcttacgactgcctcttttggagaaggtatttcttcttatggggtgtagcaaaaactatataatgtattggggggtttttacatttattataataccacgcagcacagaaaaagtgtgcacaatcttaaataaatttttaacgattttttgaccattttcacatccatcaaaaatccgcatttcctgttctttcggaaatctgtacaaaacctgccgaaaaacccacattttagctttctgccaccacattttcctgaaataatgcctcgaactcttcccgtccgattttttccttttccaacagcagctccacacatctgtgaagaacatccatatgtgcactgatcaattcttttgccttgctgtaagactcatcaatgatccgctttacttcactgtcgatcagagccgctgtctgttcgccataatttctggcatgggctagatcacgtccgatgaacacttcatcctcatcggagccgtaattgataagccctactttatccgacataccatactgggtcaccatggaacgggcaagctgtgtcgcctgtttgatgtcctgggaggcacctgttgtcacatccccgaagatcatctcctcggccacacgtccgcccagatctacaatgatattttccagcattttattcctgctgttgaacatttcatcctgttccggcagaggcatggtatagcccgcagcacccattccggtgggaatgatagatatggtgtgcacaggtcccatctccggcagcacatggaacaaaatcgcatggcctgcttcatggtatgcggtgatcttcttttctttatcagaaatcacacggcttttcttctccgctccgattcccgtcttgatgaatgcctggcgaatatccttctgggtcaggaaataccttccgtccctggcagtgatgatagccgcttcattcatcaggttctccaggtcagcgcctgtaaaccctgctgtagttctggcaatctctttaaggtccacatcttcgcccagaggctttttcctggcatgaacctgtaatatttcttctcttccttttacatcaggccttccgacacctactttacggtcaaaacggccggggcgcagtattgcagggtcaagaatatccacacggttggtggctgacattacgatgatgccttcgttgacaccgaaaccatccatttccaccaaaagctgattcagggtctgctcccgttcatcatggccgcctcccataccggtgccccttcttctggcaactgcgtcaatctcatcaataaatataatacagggcgcgttcttcttgccttcctcaaacaaatctcttacacgggaagcacccacacctacgaacatctccacaaaatcagaaccggagatagagaaaaacggaacgcccgcttcccctgccacggcttttgccaggagagtcttacctgttccaggagggcctacgagaagaacacccttgggaattctggcacctactttcacatacttctggggacttttcaggaaatccacgatctcccgaagctcctccttctcttcctgaagccctgccacatccttaaaggtaacgctcttctcactgtccacagtcattttggcacggctcttgccgaaattcatcatcttggcattgctgccgcctgacatctgccggctcataagattaaagacaaagataaccatgattcccaccaagataaggggaaggatggaagacatgaatgtattgtcccccggcacgtcacccactttgggttttacccccttttcagccagaaaattgcttagcttctggacatctgttgtgttgaactgctcctggtcaccatttttcagttctacactgacttttccgtaggggcttaccttttcaggatgaatgtaaacttccacaacctgatcattttcaactgcgactttaaattctgcctcgctgtaatcgttatttactgtgagctgccggctgaagatccaatatccgcctatgaccagtacgatgatcaaaatgacactgggcagccagctttttgcctgtctattcacgtcatgttctcctttcaccttatatcactataattccaccacaccaatataaggcaggtttctgtatttctgtgcgtaatccagcccatatcccactacgaattcatccgggatgttgaaacatacataatccactttcacgtctttcactctgcgctctggcttgtcaagaagggtacagagacgaaggctgtttggtttcctctgcttcagcacctctatgagatagctcagagtcctgcctgaatcaatgatatcctccacgatcagaacatccttgccctcaatactctcatctaaatcctttacgatcctgaccacaccgctggaactggtgtcatccccatagctggatactgacataaaatcaagactcacgggaacgctgatcctctttgccagctcacaggtaaaaaatacgccgcccttgagcacgcagatcaaatgcacctgcctgccctcataatccctgcttatctgctctccaatctcgcggatttttctgtccacgtcttcttcgctgatcagctgtctgattgtttcactcatcttccttttctcctttgacctgtactttgattactgtttttgtctgctcggtaattttgtaatattcactgatgcggtagcctaccacccatataatgtgggaaccgtccgccagcagggtcaggttttcccgctcctgccttggaatcttgcagtctataagataatcttttaatttttttcttcctcccgccggggtgacagtcagataatctccgggctgcctttttctcacggtgaggtttccttttattttatcataatcgaaccatttcgtatactttttttccggaatttgctggttttcccaggaaaaaacctgaaaatccagctctttctcccggatttcctgatcctcttttttataaaacaggagattgccataggactgctgtgctgttatgccgtgtgccagggatttctttcttcctgtcctctgtcccagcagttccagggcttcttccacatggacggaagtgatgtctctctcccctcccgccagttttgccagcactctcttaacaacataggcctgcatgaccggatgctctgtggaaatatcctttgaaaggaaaagtccctcttcattgtccctgacatacctactataaagcatatccgcctgctgtccaagatattcctccacagacagaaaagtttgtgctgcccttgcaatgtgctctgatgcacggggatttactttttccaactggggcaggactttttggcggatcttatttctggtgtaggacagttcccggttggtgctgtcctccatccatcggatgcccttatttgtcagccatccttctatctcacttcttcccacacacaaaaggggacggatatagactccgtcccccatccggcgtacaggatggattcccgccaggccggcggctccgcttccccttgccaggttgtgaaggaccgtttccgccaggtcatcccggtgatgggcaagtgctgtgcgttttccgcctgcttttctgctctcttcgccaaaagcctgctgacgcacagttcttcctgcctcctccaccgtcatatgtctctcgcgggcaatctgctccacatcataagaatacacgctgcagggtatggataaccccctgcacagctcgaccacatactcctcatcgcgctttgcctcgctgcctcgaagctgatggtttacatgtactgcctgtacggaaaacggcacctttttttgatattcccataacaaaaacaacaggcacaccgaatctgctccgccggaaactccgacgatcacccggtcgcccgcttctatcatcccgtactgctctatataagaaaataccttttcctccatattttttccttggtccattgggcatctaagtcctttctgtctcactttttccacagccctgccgcgagtattgtcatatcatcaacagccttatactcgcactgggccagtacccgctccagaatccctcttcccaggtcctgtgcagcttctgcgtgggtctgcaggattatctctttcatggtatcctccgcgttctccggaggcagggcatccagtaccccgtctgtgaccatgatgataaaatctccctcgtagagcttcttgctggtagattcataatccacctgctgcaccagcccaagagccagacttgtggaggaaatggcttccacccagtggtctctcttgataaaggtagtggctgctccggctttcaggaaatggcacataccggagtacagatccacaatggagatatccacagtggaaaatttgccctccctggtctgcagattcagaacagagttgaccattctggcggctgtctctccggtaaaaccggaatccacaaactgttccagcatgtccaccacattctcactctccctgcaggcctccagaccggagcccataccgtcagacagacacatgaaaaactggccgttgtcctccgtggtgcacatgtagttgtcaccggatatggtttctctctcctttgtcactttagccaccccgtacaacatcttgaagttcacttcctccacaaatcgaacaactgtgaactcccgtgtgatcagggttttcccctccacctttggtgtcattctgctgccgctcattttagagagcactgccccggcctcctgggcggagatacaggcttgtccctttgcccgcatctcgcagaaatactgcagctttccgtctggctgctccagcatccagacatttctcagaagtatatgcttctttttcagtctcttggcaaattcttcccggaatacagggtctgtctgaacaatatcgaacaaatccctggacagcaccttcataagctgtgccatctctcctaattgttctgcaaccgctatccggttctccaaaagtttattattccacatcagattctgtcgttctctctccattaacctctgcatttcctgcgtaagcttgccctgattaatacagaccccggtcaactccgtcttggccaccctgagcttctcctcgtccccttcctccataacacggaaaaggctgtagactctctggtatgactgtacggaatgctgcttccagcagatgtggtttgccgggcatgtcttacactgtctctctctaagttgttccaccagttcttccagttccccgcctgataagtaatctttacggtatggcatgccgtaaaagctgtctgcaagtttctggaaggatcgtgcatagcgctgcattttctctttctgtggatgctggtcgtacaccaaagtggccgcactttttttcatgtctgaaaaaatagtttttgccatgtcccgcagtatcaacagggcgctgaccacgagcatggcaatgatccattcctgcatctggtattacctcccctgaataagcaatcgctatcaaaggtgtattatagatgcttttggcttcaatctttgtcaaaaacacgctgcaaaagcgaaaaacttttagacaaaatccgttccttattcttcctctttaaagataatctgattcccttccacaagtcccagcttatctctcgccacttccttggcgtattcatctgtctgcatgtactttttcagctcatcaatttcttttgtccgtgcttcctcgtcttctattttggcactgacttcgctctttttcgtctcgtactctgctacttttccttttaatctgctactttctgccatcaaacctataaataaaacacctacaacaaacgtcacgctaaccatggcgatcttgttttgcaggctttttttcttttttcttctcattctgattcttcctgacttttcgtatcgacttttgtttagataaggaaattttaacccctgacagccaaaatttcaacctttttcttagatagtacagtggtttcagcggtatttttaataaacacttaatctttgacaaaaaaagcgaaagatacttaaccagaaaaccactcaagccccaatgatagatcagcgcgcccaggcatatccctgcaagagcatatacccttatgatcccgtcattctcaagatatatgacggagaaaagaaaaacgcctgctgcacaccagtatagcaggtcttctaggcttacaaaaaaatcgttgtgggatatgacattccggaaaatacggagtatatcgtaagctgccgcaagcaggactccggccagaaaggtcctgcagaaaaacagcagctcctgctgcatatatccgctcatattacttaaaaagcctcttcagcatgccgtctccgcccttggacttaagaaccgtcccctggctgtagacaagactgtccacctggcctgcaatgtccacctcctgtttatccagatcaaggcgggtcacatgaagctcagacccttttatagtcagcatgccggcgctggtaatcagactgatttctccatcatcaaaagcgaccacatccttcactccggttatgcttcccgtctctctgtcagtcatctgcagcttatgtgcggtcttcacctgcttctcttccaaaatagcaaatcccccatatatctctcttaaaagattatatggggggttcaaaaacaatataccgatttcaattcacattctgtaaaagcacaggatcacacagcaaattccggccgctttaaagataacggaacaactcactggccgcctcttttttcacagtctcctgtacgtcaagcacttccacacgcacattcttgctgccgaactgaatctccaggatatcaccggcctttacctgtgcagatgccttggcaggcttgtcattgatcaggacacgccctgcatcacaggcctcatttgcaacggttctgcgctttatcaggcgggatacctttaaatacttgtcaagtctcatttttcttattcgttcacagcgtcttttaaagctttgcctgctttgaatttcggagatttggaagctgcgatggtcatagtctcgccagtctgaggatttcttccttctcttgcagctctctcagaaacttcaaaagttccgaaaccaactaactgaattttctcacccttctttatctcagcagttacaacatcgataaatgcttttaaagctgcctctgcgtcttttttggataattctgttgcttcagccatagctgcaactaattctgttctgttcatgagtatttcctcctaaatgaattctcccttatttctcaataagtttcatagtctcataaggctttttaccacttacccggtaaaagcctactgttatttataccttttttcccagtgtttgtcaagcacatacatgatgcttacagagaatttttttgaatcttcgggcaaatacccatttttacatcattttatctattaattcctttacagcctgtcccagtgcagcggatttctcatctgcatctgccagggatgtccccttgatcccgtaatataatttgatcttaggttccgtgccggacggacgtacacatacccatgcatcgtctgtcaggtcatagtaaagcacattggagcttggaagtccggttgcttttacctcttttgtctccatattgatgactgtatctgccttgtaatctcttgcagaggtcacctggtaatcaccgatcacggatggagggttctttctcaggttctccagtatggtctggatcttctccaggccttcaattcccttcagggtgatggactggatatcatctttataataaccgtatttgtcatacatggcgatcatggcatcccacagtgtcatgttttttgtcttgtagtatgcggcagcctcacacagcgccatagttgccacaatggcgtccttatctcttgcgtgggtaccgatgaggcagccgtagctctcctcaaatccgaacagataggtgccttttcctgatgtctcgaatcccagtatctgctggcctatgtatttgaatcctgtgagcacttcgatgaaacggataccgtaatgtctggcaatggcgcctgccatgttggtggtaacaatggtggataccatagctccgtcctccggcagtcccttgttcatctcttttctctgaccgatctcataatcagcaagcaggcagcctgacatattgcctgtcagagtgtggtattcccctgttttgctgtcttttacgcggacgcccagacggtctgcatccgggtcagttgccagcaccaggtctgcatccacctcttttgcaagcttcaagcccagatcaaaggcttcgtctgcctccgggttgggatagctgactgtggggaattctccatccggcaattcctgctcttttaccacatatacattttcaaatcccagctctttcagcacgcgtcttgcaggaatatttcctgtgccgtgcagagggctgtacacgatcttcaactcttttgccatagctttgatggcatccatatggatcacctggcttttcagctcttccatgtaggcatcatccacttcctgaccgatcacctgatacaggccggctgcctttgctgaatcctcatccattgtcttcactgcggcaaagtctgtgacttttttaacctcgtccatgattcctgtgtcatgaggcggtgtgatctgagcaccatcctcccagtaaaccttataaccgttgtattccggcgggttatggctggctgtgatattgatcccggcaatgcatccgagctttctcactgcaaaagaaagctccggtgtggggcgcagggaatcgaaaatataggctttcacgccgttggcagccaggcacagtgccgcttcttttgcaaattccggggacatacggcgggaatcgtgggcgatcgccacaccttttgcctgcccgttcactgctgctatgtaatttgccagaccctgtgtggtctttctcacggtgtagatgttcatgcggttaatacctgcaccgatcacacctctaaggcctgcggtaccgaattccagctctttataaaagcgttcttttatttcattctcatcatctttgatcgcttctaactcttttttagtctcttcatcaaaatacgggttggagagccattcctcataaagctttttgtagtccatattctactacctccctgtgcaacgttgatttatagtgtgcatcccgggcgccaactcctctatggtctgccggacaacacatttatggattacattatacactatcactgatgaaaattcaaacattgcacaggggttttcagcaactttataccgaaatattttcgacaaagttcatccaattatcatgctgggctataagtttctccagtttttccaggtttttctcagaaatccatgccttgctgtgggaatagtagtagtttgccagtttccagtatttctccggataggcaaaacggatgcgcaggttttccagttcctgcacattcaagggtttctcttcgtgataggccagaagcatctgccgccccatctccagatcccagttatgcttttccaatattttgcgcatgaactggtaaaggtcctccatctggatatcataatgccatcggtcaaaattaatgaccgccgtattctgggccaatatcagcacgttatgctgattgtattctccatggcagacatcccctgactccagggaccggcatcgcagatcctcatacccggagcagttaagcctcctctgagcctcctctgcatgccacagatagcaggaaatgctgtccagatatctaagctcgaaatcatttttccggcgtttctggcagacaaatttgcggattttccgcagctccctgtttttcctttcatattccatgagaagcggctccttgacatagtgtgtctgaaccggcattttcattgttttatgtagacttgccagggctgttacgctgcgtttgatgtctttcattgactgggtatcacattctcttccttcgtaccatcgctttaccacatagggtatgttgtctttgtcagttgagacgtatgcaccttcctgattaggaaggagtgaatccacgctgatttgattccgggtgcttacgatctccagaagcttcgcctgataaccaagttttctgggtgatccattgtattcacggatttgaaccagaccggcctgggtgtcgcagatgagtgcacctcttccgcggtatgtggattttgcttccagaccgtattgcgccagtacgctgagacccctatcatacacttccttgtccccctttactttgtgtcctctctattttatgcaggagatggaagtagtagaaggtgaaaaaatatgtgaggtggcgtggacatgcaggtgatattggaaagagcgggaatgcagatggatgcagatggatgcagatggacgcaggcggacggaagcagacggggagggaatggcagcgggtggctcctggctccgctcccctcagctaaccggctcccagttgctaaattcgtcagcaatggcttcctcattaatcaactggggcaggtggatcttcggctcgctccacaaaacactcgcctcccgctgctccccctgccattccctccccgtctgcttcctgacttttgacttaccgcttgtttgtattcggcttgcctgttgaaataaatttgttatgtaattggttctctctatattacaggggtaaggactcttttattctgttagacattggttggaaataatgctgatgttaaaatatttttaagaaatggaaatttacctggttaaacaatatataaggatagcttgctgaatttggagtaaatattgtttaaactcataaccgacaaaatattctgaatctattacatcctcagaaacttcttctccgcggtaaaatggaggacaggggtttaaaattgcccctttatttgccattttcattacttcaagtgtaacttggcagtttttaaaatcatgaagcaaattcgagggaagagaatctgtacaaataatatcttttcctataattgcttcttttatattattataaacaggtaatccttgcatctcatgccctgtactgtagcattgggataattcaaatcccataacttcggatgcctccttccaggctaaaccaatattccctgatttaccgcagaataaatacttatccttcacaaaatcttctcttatctttgataatgcatacatatcggcaatgacttcacaaggatgatcaaagtccgtcatagcatttataaccggaacttttgaataggcagcaagttgttctaggatatgaatatccttatgtctggcaataattacatctgcccaattattcaggtagccacatacatctttcaaatcttccttcttatcgagactttcattcggaaacaaaatggactgtccgttcaacaagtatattcctttttcaaaagtaacccttgttctaatacttgactccggaaaaaacaggaccacactttttcctttttaaattcccttataatttccttgacaaattccatccgcaatacgaaaaatatgataaacctccctggaatcaaaatccgtcaatcgaagtaaatctttcattcagaatcacctacacaattccaaaaatctcaacactcaacaacttttccatatatcgctcaccgtgagggctctctttcatcatttcccacacgtcttccaccgtcagtccgaacatgcggtgcagtatgagagggcgggccagggatacagactggcgagtgttctgcggagcgagccgaagatccacttgccccagttgattaatgaggaagccattgctgacgaatttaacaactgggagcaagttagctgaggggagcgcagccaggagccagactgtatccctggcccgccctctcatactgcaccgcatgttcggacgtccgtgagccataaacttacaatccagtctcctaaccttgcaattcctccctcacaattttcatcaattcccccctatcattcctatccggctcctccagcaccacctgtagcagcctctccagcatctctcccatttccggacccggtttcatacccgctgcgatcaaatcccttccgttgacagccagcatctttaccgaaacgcactctttcttctccagcacatcccggtaaatctcctccaccttccggatgcgctccagcttttcctctctttggtactcactctgcgccatactgtccgcatactgcacttttaaaagcagaggaaacaactccacgcccaccttattcagcgctctgcgcaccgctttgggattcggttccggccggtaatcatgccagtaaaccagctttgtcaccttgtcaatggtgtcattgtcaagcttcagccttctcagcacattcttggcaattctctcactgcccagactatgccccttaaaatggtctctgccattctcatccgcagttttggaggccggctttccggtgtcgtgaaggagcatggtaaatcgcagaactttatctgcatccacatactccaggcttttcagcgtgtgttcccccacgttcagataatgatggggggtattctgcggagtttccatcatagcatcaaattccggaaggacaacagcagtgatgcccgtctcccaggctgttttcaacagataaggattttttgataccagaagctttgtcagctctgaggcaatacgctccgcactgatttttgcaagtgaaggggcaagctcccgggctgccttttttgtctgctcctctatggaaaatcccaactgggccgcaaaacggactgcgcgcaggatgcgcagcgcatcttccgtaaagcgctcataagggtcacctacacagcggatgatccccttttccaaatccctgatcccgccgaaagcgtccaccagcccttctctgtcattgtaggccatggcattgatggtaaaatcccgacggcggagatcttccctcagttctcctgtaaagaccacctcttttggatgacggctgtcctcatattccccgtcaatacggtatgtggtcacctcaaatccttccccgcccagcatgaccgtcacggttccgtgaacaagccctgtatccaccgtgcggcgaaacagcgccttgacttccatgggtttggctgatgtggtaatatcccagtccgccggagacgaatggaggaggctgtcacgaacacagcctcctaccgcataagcatcatatccatgttcctgcaaggtttctattatctcttttactctcttaggaacttctattttcattctagtacgcacgcccccagtagaccatcttcttagccggttttccacagcagacacatttatctgataaggtttcctgctcgaaaggtatgcagcgggatgttgcctggacgtcctctttgatcttatcttcacattcctggcatccgcaccacatagcttttacaaatcccggcttctcattgaccgtctgtttgaactcttcataatcaactgctacatatgtgtgtgcatcacgatgggttctggcacgctccagcatatcactctgcatggtttccaggatttctgctgctttctctgccagatcatcaaaggataccactgtcttctctctggtatctcttcggacaatgactgcctggttggcttccatgtcttttggtccgcattcaatgcggatcggaataccgcgcatctcctgctctgcaaatttgaatcccggacttttatctgtctcatccaccttcacgcggattcctgcagctttcaatgcatcggcaagttcacgcgctttttccagtaccccttcttttctctgctggataggaataaccacagcctgcaccggcgcgatcctcggggggagcacaagtccgctgttgtcgccgtgcaccataataatggcaccgatcatacgtgtcgtcattccccaggatgtctggtgtacatattttaaggtgttgtccttgtctgtatactgaatgtcaaatgcctttgcaaatccatcaccaaagttgtggctggtacctgactgcagggcttttccgtcatgcataagagattcgatagtataggttgcctctgcgcctgcaaatttttccttgtctgtcttacggcccttgatgaccggaatcgccagaacttcctcgcaaaaatcagcatacaggttcagcatctgcaccgttctctcctctgcctcctctgctgtggcatgggcagtgtggccctcctgccataagaattccctggagcgcaggaacggacgtgttgtcttctcccaacggacaactgagcaccactggttatataccttcggcagatccctgtgggactggatgtctcttgcatacagatcacagaaaagcgtctctgaagtaggacggacacagagtctctcctgaagaggttccagaccgccgtgtgtcacccaggcaacctccggtgcgaaaccctctacgtggtccttctctttctggagcagactttccgggatgaacatggggagatatacattctccactcctgtctccttgaaacgtctgtccagctcatgctggatattttcccagattgcataacctgccggttttattaccatacagcctttcacgctggtatagtctaccagctctgctttttttacaacatcggtataccactgcgcaaaatcttcctccatggaagtaatggcctctaccattttcttgtcctttgccatagtaatgctttgtctccttctactgtttattttttataggcagccgcaccctgccatccacggccttacaaaagcggctctgtaaacggcactgctcacacatcaaagctgatgtttctgcccgtgtgattatatttataatatcggacacctgcggcatcaagcattcgcttggaagcctgaactgacggagtatccgcgtatttatcgctgtcatagacaattgtcttaattcctgcttgaatgatggccttggcacattcattgcatggaaacagggatacatagagcttggcaccttccagtgaacctcccctgtagtttaagatggcattcagctcactgtgggtcacatagagatatttggtatccagttcgccgccttccctggcccatggaaacacatcgtctgagcatccctttgggaacccattatagcccatagacaaaatcttgttatccgggctgacaatacaggcccccacctgggaattgggatctttggaacgcattccggaaagttttgcaacgcccataaaatactcgtcccaggatatatagtcacttctcttatctgtcatcttgtaaaacctcccgaaaacactgctatttagttccgaaaatacggtctccggcgtcaccaagtccaggcacgatatagccgtgatcgtttaaatgttcatccagggcgccgatatagatatctacatccggatgtgcctcacttaaggcctttaccccttccggagccgcgataacacacataaaatggatatttttcacgcctttttctttcagcatggagatagctgcctctgcggagccgcccgtagccagcataggatctgtaacaaaaacttccctctcttcacagtcagcaggcagcttgcagtagtattccaccggcttgagtgtctccgggtcacgatacagaccgatatggcctaccttagcggcaggtatcatggtgagcataccctccaccatgcccagtcctgcacgcagaatgggaactacagccagtttctttcctgccagttctttgacagtcgtctttgtgatcggtgtgtctatttcaatgtctcttaacttcagacctctcgtagcttcatatgccataaacatggcgatctcacttaccagctcccggaaatcctttgagcttgtctctgtgcggcggataataccgatcttgtgctgaatgagcggatgctccattaccattattttccccatctattttctcctttgtcctctattttttagtcttgttttatcttcgattcgtaactgttcagttcccttcagttacgagccaaaatccatgcaaatcgcctttggcgatgggatttttgcctggctgatgaacgttttcttacggtcagcacagtaaatgtgcagatttactgaatagttacttctattcttctatcagatcgatccttctctgatgtctctcctcaccggaaaactctgtattcaaaaaagtatccactatcttcacagccagccccggccctactacgcggcctcccaatgccagtacattggcattgttgtgctgtctggtggcctcagcacagaagcagtctgtacagagcgctgcacggattcccttcatcttgttcgctgctatggaaatgcctatacctgtgccgcagatcaaaattcccttgtcacactctccgctctgaatggcttttccgacttttctcgcataaatgggataatccacagacttattgctgtcacatccgaaatccttgtatggaatcttgtgctcctccagatatccgataatctcctgtttcagctcaaatccgccatggtcacagcctaatgctaacatgtaattttcctcctgtattttactttctattatgacagtgcagacacactctgacacagcctgcggccgataggatcgtgtgtcttgtcacgcccaatatccctttttccggtctccggctgcaagggcgtcaaacgtgtataagatgatgccctgctgccttgagcagacgattcataatggcctgtcccatccttggtgtatcaaaagcctccgaaaaaatatagtccacctgttcctggtcaaattctctcaaaagtccgaacagatgtctcgctatactctcctcgtcctgccgcgctccgatactttttataacctgtgcctcatagtatcccacagtctcgtccgtgccgataacacccacacgcttgccctttgactgcagatcacggcttttttcattgatggttctaatgaccatctctgtactgccttccacaatagtcaaaccggcctttggcgcatagtggcggtacttcatccccggggcctttggcttaatattttcatctgtgatcaaaagccctctatccatccgcacaggtcctatcacgtcctcagccatcttctgattaatatatccgggacgcagaatgacggggatttcttctgtaaaatccacgatcgtggactccagaccgatccccacatctccgccgtccaggatcatgtccacttttccggttagatcctctgctacatgggaggcactggtgggacttggacgcccggaggtattggcactgggcgctgcaatatatcctccgccgtgacggatcagcgccagggctaccgggtgagagggcatccgcaccgctacgctgtcaagaccgcccgtagtctcataaggcaccgcatcgctcttttttaaaatcatggtcagcgggccgggccagaacttttcagccattttctttgccttttccggaatctccttgacaatcctgccaaggctctccatgtccgcaatatggataataagcggattatcagagggcctgccttttgccgcatatattttttcagaggattctgcgttcagcccgtctccgcccagcccgtacacagtctctgtgggaaaagccaccaagccgccgtttttcaggatttctcccgcctgtctgatcacagattcatccgggtgttccctgtctactgtcaataatatggtattcacattttctctcttcttcctgtctgttctttacatacataaccataataccattgtctctgcggtttttccacaatttttttataaccgacataagaatgtattaccgaactcaacagtccaggcaggtccaggcatttactgtgctgactgtacgaacaggcagtgccatcggtcagtcattagacatttggcttcacagcagcaggagtacacacacagactgtatcagatacagtccggtgtgtggctgctccgggatttccctgcattttaaattcatttctatttgtcacccaaatatgtaagaatgccgtcccggactgcttttgccaccttatcctgatattcgtctgattccagcagacctgcctccctggtattactcaaaaaaccgcattccacaatatttaagattccctcgctgcgcttcagcagataataggtagaatttgctttctctatccttggtctgctcacatcaagctggctgttcatggcgtcctgaatgcactttgccagctttcctccctctgacgagtgagtaaaatagaaaacctgcggaccacagactgcctcgtcaggataactgttctggtggatactcacagtgagaagcggctgtttttctttgataagctcgcaccgcttctgcatatcctgcactttcttgttcctgctgtctgcatcgtacagccccccatcctcagacctggtcattatcacctgatatccctctttttccaatagcttctggagtttttttgatattttcaggtttatttctttttcctccagtttttttatgcccaccactccgggatccattcccccgtgtccggcatccacaacaatgacacctttctttccttctgcttctttgctcaccagccgcgcgccttccctggagaggagaaatgcggatgcgagcagaagaacagccatccccagttccacaaaacgtcttttcttcatcaaataaaaatccctcaaagcctactcgttaaagtatatgctttgagggactatcctaatcttttaattttccgcagccgtccaataccctgactgtcatgtgtaaaaaccatgccgtatggtctttggcaaattttgcccggacacggaacggtactaaccaccgctttagtgaatgcgcagaactgctgaatcgttacagattttcaaagaacttctcagcgggcaccggacgcccgaaataaaagccctgtatcagtctcagccccatattgcccacactgccgtactcctcttttgtctccacaccttccaggcagacctgtttgcctacatcattgcacaattccgtgatagaacggatgaatgtggcgttgaacagatctgtagtgattcctttcacaaatcccctgtcaatctttacaatatcggcagggatatgcttgagcatagacagtgaggaataccccactccaaaatcatccattgccacccggacacccattttctgaaaactctccagtgtctccctgacaatggcatcctcttttacaaagtatgactctgtcagctccagcgtaagattggaggggctgagatccacctctttcagcgtgtctcttacaaaggacgtcaaatctccttccagaaactgttgataagacagatttacgctcatattaaaatccggtttccgttcacaccattttttgcactgagcagcggctttgcgcaggatccacatgcccatcgagacgatcagaccattctgttccagcagaggtatgaactcacccggggaaacatcgccatatttgctgcagtgccagcgcgcaagtgcctccgcgccgtaaagctctcctgtctttgcatccacctggggctggtaacagacagaaaagcctgcaaaacctctctctacgctctctctgagcatctgtaccatttccagcttcttctctttttccttaggtatctctgaagaatagaccgtcatcctgttcttgcccatagccttggagcgttcaagcgcatagttggcacactttaaaagctccagataattatctgcattatcaggacagactgcatatccccctgatatggtgcagtaatatttctttccattatattcctgctggcgtgtatattgcttctggatctctgagaaaatatcctctgcgtccttttccgttccgtttgtgatgataatgccaaactcgtctccgtcgagacggtaaattctggaattttccggaagtatacttcttatattccctgccgtcatccgaaggatctcatctccgaacatccggtcatagagatcgtttatatttttgaaagcgtccatatccaggatcatgactccgatccgggtgatctggctgccatccatgagatatttcttaatgctgccttcaaattcaaaccgattgtacagtccagtcatatggtcgatctgtttttctttgcccagattcgtgatcattccggcaaacatgtcaggattgccgtactgatcgcggatcaattttcctctgcatctcagccagatccattcaccttctgcatttcttgcccggtactcaatgtcgtgctcctctgcacgcccatccgcaatttcctgattgctctctaaaaaatgcgcttcatcatggggatggatcaaaccgctccaacaggctgctgcattctccaccacctcacccggcagagcaaattctgccgccattgcaggcgggtatctgaaaacaccggtcttcatattgcctataaatatatagtcatctgtactcgctgtcagtgcatcgtaaagacgtgcctgattatattgaaaatcatcttcggttaccgattccgcatcagcatgcttcaatttgcttttcgcgcgcaaaatatggtaattccgcttctgcacatacatcagttcgtccgctttcgctataatatccgaaaccgtaaagcagtcctccgggtagatttccactgccccgtaggaaaaagacggactgcattccagtccatactcctcatactctcctgccagtatttccaaaatcttctgtatacgtttatccgcactggccagctcttccccataaactgccacaataaactcatcactgctcagacggaaaataatatcctcgggacgcagacaacgcctggaagcagacgtgacaaattgaagcaccctgtcacctgccctgtctccataacggttatttatccaattcagactatcaatatcaaacattgccactgtcagcgtctttttctcttttttagccctttttatgatcaattccagcctgtccttgccttctctccggctggatactcctgtcaaagtatctgttgctgccagctgccacaactccctgtgctccataacgacctctcctacacaaaaaaccttatccctctgctgcttgctattatagatgacagcagggagcgatacaagtctattctaccacatattgacaataaattcaaaaaagtccccgggatttgtcttcccggggcaataggcagtaaaaatcatactccgcttttcagcttctatctttcattttccagttcttcctcaagaagagcctcatcttcttcactcaaaagttttgatatctgcattgcaattttggagtcttcatcttcctcaaactcctcaagttccgcaatatcatccagtgcatccaaaagatccagttcctgggtatctcccagatgaagctcctctgcatcctccgccggcggcggaagttctacatccggctcctcttcaatatcattcagtgatgtaggcattgtactgatgatctgatgtacctctttataagaagccatgaaacgcttctgggcttgattgatcaactgtacgatctcattcatctcatcctgaaccgctatgtattttttcttgccctcccgcagtttatcatcaatttctgactgcactgcttccacgcgctgttttgcctctgcttccgcgtcagaaatcatggtattgcacttctcctcggcctctttgatcatggcgtctgactttaactgggcatcaaagaccagttttcctatgctctcataattgtcaatgtacttctgatatttctcatggatttccatttccagacgctcctgatgggcgtcctttaactcaatgcgcttcataagctctgctatcttggcatccttttccgaaatgagctttttcagccttaactgttcagaggcagcttcatccttcattcgctgcacctgttccagcacatcctccttatcaaatccccccatgatcgtggttttaaacaattcgtgttctcccattactccacctgttcctttctgaatcacattcttgctgtttttggcctttactgcaggtactggctgatggtgttccacacatcagctctctcaaatcccagtttccattctgccacgcctcccagctcatacttttgtatcaactgcatcttggcatccagtgactgctcatcctccagccatatctgatacaggccgttatctgtagccagttccgcataattttgtgaaacctctttgttccaatacttttccatacccatctctgccacaatcttatctgcctggtccatacccatgatctcactcgtcacagttccggcattgtccgtaaaccaaagtctcgtatagaagggaaccccattgatcaccttattcttaggaacctccttcaatgtctgctgaattccctcctccacaaatggcagggaggcaacagaacctgctttctcagttccgtctgtatgctcatcataccccatgataatgacataatctgccacgattccctgttctttcctattataaaaggaagtaaactgcggaaccggatcatctatggacagaaccagattgtttttccggcaggaaatggacagttcgcggataaactggataaaatgaggtgcttcctcctgggtcagcgtctcaaaatccacgttaatgccgtccagacccactcttgccgcttcttctatgagtttctgaatgagatgttctctggatgtgcggtttgacagcgtgtccagagtgctcacatctttgttgaaattatcgatcaggccccagacttccagccccttttcatgggccagcttcacataatccgcactggccagggaggagatggttccctctgcccccgtgacggaaaaccacgtgggagaaatcacattgatccctgttatgccctccagcgtctgggctagcccggcattggcatcctcagaggtaacctgatgccacgccagattgatcttatgatctcttgtgagactggtaaactcttctttatagctgccgtcatactccacgtccttctcctctgacgctgtcaggtcttcttttgccacatagccgttgaagccgtccggagttgccacctgagaccaattgtccagctcttctatcaatgtcagttccgtaccttttgccacatctgccaaaatatcgctcttgatgccgccccggtaacggatcaccgtgtcattcttcgcttttacgatcttttcacttccccactggtagcgaattaccgccttgttggggttttctgtcaccgtactggtgattttcatatatttctgaataaaatcaagtgccagataaattttatcatcggtctggcggatgatcttatagccttcgtctttattttcaccgttcactgtataagcagtgctctccggtgctatggtaagaatctcatttggtgtggtgtaaagcatctgtgagctgtccgcttcccagtaaaaacgccctcccagcacatttgacacggtatcgtaatccagatagacgtgtccatccatcaatttacccttcgcttcactcactgtattctggagcactaaggccacatcatcctctttctccaatccataatacgtgttcagatccattctcgtatcggaaggtgtacgtctcttgatcgcggcagtcagcactcccacagctgcaaccactactatgagaaggataactaccagtaccataacggcattgctgttccttctccttctccgccttctcttcttttgactcataatttaactccttattttttctcgcatttctccaccattataacatacttttttcgttcgtcattactttcttcgacaatttatatttttttaatagtagaacttaacagccggattggggaaaatccctcacaagcacagagatcccccctgttccggccccctgtcatacataccgggaacgcaaatatcacagggtttcctatatggcttactcgtttttcacgaaatcaaactgcagcttttcaacctcccctctctcattctgcacatagtcccgcatatagacaccttcctctgcgacactgcatgcctgttcaatttcttccggagtgctcggacttccgttcagcataaggggaatcccctgacgccggtaggtttccagttcacaccggagcgctgaagtttccttgtctttcttcatgtttactgtggacagcagttcgtgatatattatacctctgccctctcctttcttcttgaaacgcggttccaatattacagataaagaaaggcgctgtaatccccataaaaaatatatccatagtctgtgttctctgtcacatgggatcatgcaaatcgtacagaatgtactctctgcctgcggtcagacgccgcctgaaatgaaaattaagaatattgtcattgacgaaggcctacgggatgtcatcactcccctctgtaaaaaattttacagcactccttctttgtctgtggaaaccattatatcatatatgaatttgacttagcaagccattttatgtaattatttcttattttgatcatatttttacttttttccacatatatgaaaaaagtatgaagcgctttacatacctgcgtttcatagtatataatataagtgagataccagcatctttgttttgcctgaagggcagaactgacagatagacaggatgtgataaaatgaagatagaaaaaatcaacgacaaccagatacgttgcacgctcacaaaggctgatctggaagaccgtcagattcgtttaagtgaactggcttatggtacggaaaaggccaaagacctgttccgtgatatgatgcagcaggcaaactatgaattcggttttgaagccgataatataccgctgatgattgaggcgattccggtttctgcggacagcattatcttgatcattaccaaggtggaagatcccgaggaactggacacacgtttttccaagtttacgcctttcggcggacctgcaggagataattcacagccgcctttagaatttgaaggagctgatgacatcattgatgtattccagaaaatttatgaggccaaagcaaaaagcgcagccaagaaaaagggagtgaaaacaccagcgccgacagagtcaccggaagtaccggtccgtcttatacggcagtaccgttttcaggacctggacggcgtgatccgcgcagcccgcggtctgaacaatttcttccagggagagaactccctctacaaggacggtgcaacaggggaatatgaactggtcattcaccagtcagagaacaccccgtccgattttaataaagtctgcaacatgctttccgaatacggaaaaggcagtgctttttcacaggcaggcgaagcttatctgagggaacacgccgaacgcattattgccggcaaagcactacagaaattggcagccctataaccggatgctggtaaaaagccccggcggatatccatttttatggagaccgccggggcttttcatcttcaattatttatctgccagaaaatcgttgatctgagcagccagaacatctgcatcaattccatgaaccatagcagcttcttccaggctttcaccctgagcggaaggacagccgatgcagtgcataccggctctcatcagaatcggaacaatattttcatccacacggagtaattcgccgattgtcatatctttggaaattgtcatgatagtttcctccttttttcgtactgtgtattattataaactctttttctcctatattcaactgtttttctccggttttctttttctttccaaaaattgtggcagtggtcacagcagatgccttgaaacggacagctggtactcctgtctgcagacttgaactccatttcccgccggatagcccacttgcctgcaaacaagaataattcacggattgtttagaaataaagacttgtattctaataccaaatatattagaatatgcgtaagaactgaatcttataccaacggatgttccgaattttaccgctgcgctgacgcggggataagataaggtagggttcagaaattataaaaggaggattttaagtatggcatatgtaattacagacgaatgcgtaagctgtggaacttgcgaaggagaatgcccatctgaagctatctcccagggcgatgacaaatacgttatcgatgctgacaaatgtgttgactgcggaacttgcgcagaagcatgtcctacagaagcaatcgtagaggcttaataaaaaaacacaaacctgttttactgcaggtttgtgtttttttattatctttttttcttaaacaattttttattcttctgccgctcctgctccatggccgccgccacttccctgcgggatttctgacagattctgatcctctcatccagccttttatagcgttcttccccggaatgaagggtccgcatccgctcttttaccagcctgtccagtatttccataaactctgccggaacctggctttcagcttccgcctcagcctgtactggcgcctgccgcattttgccggtgactgcacggttcttttcctgagcggagttatgattctgaaccgggttatgattctgaaccggcctgttctttctggcggccgcttttcttgcagctgcccttttgcttttccttgatgtaggtatttctcttctctgctctgccggtctctgtcctgccggctccggtgttttttgctgtaccgtttcagtcactttctcccggctgccggttgtcctttgttctgtctcatcccggttttcctcatccttatataaaaagggaatcaggctgccgatttcttttaatgcaagtccctttttcttcagttctttaatagccagaagtacctggatatcatatcgggtgtagtatctgtgccccatttcgtttctgtcgatcggcagatgcagctcctcttcccaaaagcgcaggacatgtgactgcacgtccaaaagcttcgccgtttcagaaaccgaatagctggtttcactcatacactgaccccttccattttgcgtcgcaactgttcagtatcttcaaagtttgcgtctttctttaaggaatattatagcaggggatgaaaaaaatgcaagaaaatgtgttcgacaaaagctgcgggaatcttattggcaaacgtaagctccatccacgatcaggtcggttccggtcgtatatgcagaggaatccccggccagataaagaaccgccccgataagttcttccggagtccccatcctgccgtagggcatcatgcctttccaggcatctttaagctcctggggtgtatcgacagacattggtgtggatatgtatccgggacttaaactgtttacccgtattccgtagggaatccattccagagccagagactttgtcaggtgtatcacaccggcttttgaggcattataggaggcctgccactgaggtatgttcacaatggtacctgacatggatgccatgttgatgatgcttccgtgtatctttttccgtaccataagctttgcagcgctgcgggccataatatactccccggtcaggttcacatcaaccacacgcctgaattcctcgatactggcctcaaaggtacttttgtggatgcagataccggcattgttgaacagcacatgaataccgccgcttctcttctcaatctcttctaccgcccggtccacgctcttctcatccgtcacatctgccttgatatcataggccctattcccatcctcctgaatgatccttaccgtttcggccccaccggaacggcttaatatgacaacctcagcccctgcatttgccagtcctctggcaactacctgaccaattccccggtttcctcctgttacaacagcagtcttgccctcaagtccaaaaagtttgtccagatatcttcctgatttttcagacacgatcatatccctccttcagctctctgtagatttcttctatatccgcgattctggggtttgcctgataatcaggcagttcatgtcccctctctgctatcttcctaagtatatcatattccacaccaaattgagggaaattcagccacattcctatatctttcatgagtttttctatttccctgcagcactctgacgcggctttggcatcaggtgcctctctcagggcaggattgaagatacgcccaacttctgcaaattttttctccgccgccggacaggtaaactgcaaaaaggacgggtatatcaaggccagagattccccgtgcatgatctgggggcaatggccgctaatagtcatgcccacaccatggggaagcgtcactcctgcattggcaatcgccagcccaccgcacgtgtctgcccaggccattccttctctggcgtccatatcctcaccgtttttcactgctcttctcagatattccacagtgtacttcataccctcaagtgcgatcatgtccgtatacggagaagccttgacattgatatagctttcaaagcagtgacagaacgcatcaaatccggtggacgctgttatatgggccggcatggaaacggtaagttcaggatcgatcagtgcaacgcggggatagatcaaattgttgaaaatagcgctcttagtacaggtctctgtctctgtcatgaccgctacctgcgtcacctgtgaccctgtacccgcggttgtcggtaccgcgatcacaggcagcgtggcttttggctgcggacttttaaaaaacagatgatcccacgccttgcctccgctggccgccgtcacagcaatggcttttgccgtatccatgacagaaccacccccaaggcctatcactgcctgacatccttctttttttgcaacagcggtaccctcctccacgcattttgtggtggggttttgtgctacgttatcaaagtgccaaacagtaagtccgctgcttttcaggctttctatgattccatcatacaatttttccctggtggactttttcctgctcgtgaccagaaggatcttatcaccaaatcccgctgccaaaccgggaagttctacaatgctgccctttccgaaaataatttttgttgtctgctcatattcaaaccgtttgttcatatgcacgcccccgtcatctgtaaatattctttctcttgatcttcaggacagtggcaatgttgttcttcctgacatttgctgtgtcaataaggagtacgtcatcttttgcagtccatgtaagcggccgtccgtcacccagaacgcttatgctctcaatctcctctttatagaccatcggaagtatatggtgcagtgccgtcttgtctcctatttttcccagcgcggatgcatagatatattcgtccctcatggtataccgaatgtctctcggtgtatattccacttcatccatctcacaaaaagcaccggagcctgtcatttttgtaggtccttcctctgctgtgcgccatggtgtagtatcatagacagcttccccgttctcttcaagccattctcccatttccagaaggatttttcgggcttcttcgggaattgttccatccggctttggtcccacattcagaagcagatatccgtttttactcacattgtccagcagatagtggatcagggatttggctgatttatactctgcatcctgcatatatccccatgcttcccctgcgtccacggtagtatcggtgatccagtcatgatatgtagcttcagcaaatcttccctgttccagatcgatcagaccggctcccacgggcagatgattccatttataggaaactgctgtctcctgtctgtttttctctgccatatccctgtaatacgtcagaaattttctctggtaaaaatcattgataaaggccagaccgaaatcaaaccatatgtaatccggcctatatgcgtctataacctctttcagctttataaaccacttttcatggaatgcggcacttggaaggtcctgggctatccactgcctgtctatggctccgtccatggtattagaccagcggatcggttccggcatatatctcttatcagaaccccagtccatattgtgggcttctccgtacaggcctgcgtatctgggatctgaggtgtcgtattcttttacccagtgagggtaaaacttccagttctctgcgtgatgaaaagctgtcataaaatacatgccctgttcccgcaccgctttttccaactcccctaccacatccctctttggtcccatggctgctgcattccattcattcacacggctgtcccacatgctaaacccgtcatggtgctccgccaccgggcctgcaaatttagcacctgcttttttaaacagctctgcccattctgcggcatcaaatttttctccggtgaacatagggatcaaatctttatatcccgtttttgacggatgtccgaaatgtttgcagtgataagcaaactgatccgtcccctcctggtacatcttatatggataccaggaaacattcggtccgaatgccggcacactgtaaacaccccaatgagtgtaaatgccgaattttgcttttttcatccattccggtgtccggtaatctgtcagttctttccattctttaacttttatccccataaatttcttctccttttttatttattggctccgcttgtcagtcctttaaccacattttcctgaagcaccaaatacatggtaagaggcggcagaatggctatgaaaatggctgccataagcgcaccgtaatcactttttctggcccctacaaaattcagcagacccacagaaatggttctgagttctgcttttccgatgaataccatggagaccagaaggtcattccaggtatacataaatacaaatatccccacagtggcaatggcaggctttacaagcggcaggataattctggtgaacactttgtatatactgcagccatcaatgatcgcagcttcctccagagaggtgggcagactgttcatggagcctgttatgataaaggtggccagaggcatatgtgacgccgtaaaaagcaggatcaggatcagatagttgtcccggatgtcaaaattattgatcgcccaggctaaaggtacaatgatactctgaataggcaccatcatgcccatgacaaaatagactctgactgccccctgtcccttaaagcgcagacgtgagatggcaaaggataccatacttgccgccagcgccgtcagtgccagtgtcacaacggccaggaacatactgttcaaaaactgccttcctatatttccaatttcaatagccgttttataattttcaaaatgaaacgccgaaggaaatttaaacggtgaggtaaaaatctctgtattcgttttaacggatgatatcataacaaaatacaaggggtagataaaaataaagagaaaaaatagggaaaccaggtataatatgacttttttcgttatttttctagcgtgatcgttcatttttcctccttaatattccagccgttcccgttttgtaatgcggagacttatgacagtaaatataatgctcaggataaagatataaacaccgataacagatgctttcccaaagtcattgtatcgaaatgcctctttataaagcagtgtactcggcacatctgtcaggccgtttggacctccttctgtcataacatagacaagatcaaaggttttcaaaaccgcagttacgatgaccacaatgcttgaaataatagattcccagatcattggaatgattatatggaacaccttctttattcctacagctccgtccagcttcgcagcctccaccacatcatcagggatccctgaaatggcagcatagctgactgtcatgtggaaaccgatgccgcaccaggcatttaccaggataatggttgtcatggcagtatttttatccaccagccagctctttaccaggctgtccagaccgattccctgaagcatggtgttcaaaacacctgtgggcatcagtataaaataccataagagaccgataaccgttgtggacagtacctgtggtacaaaataagcaaatttgaataaacggtatccccggaatctttcactgagcataactgccagcaaaagccctatgggaagctgcgtacacaatgtcagcaccatgaaccacatgatatttttgatggaatgccaaaacatggcatctgtgataaccgccttaaaattactgaaccccacaaacaccatggggacattcttgatcccgttccatttaaaaaaggacataaccagggaaccgccgatgggaaccattaaaagtaccgtatataaaaggaacccgggaagcagaaaacataacactgcctttttattccttcttattctctccattgctgtgcctccttttctgaagaggccgccgcagcatcatactgcagcggcctcgtgctgctcccggttattgacctgaaccggccgcctccaaacggctctgaatctgttctgccgcttcatctgccgtcattcctgtaagtgctccgataaatgcttctccgacgatatcttccaatacggctacagtatcgtatgcccacgcatcactgccccatacctttacgtccttttccttgatctccagcagatcagagaggagcggactcattttgtctgcatccaattccacatcgtttctgaccggaatatttccgcagtcatatgcgtatctctgctgggtctctttgtcagcgaacatacaagccagttcccacacgtatttcagtttctccggttcatccttcaagtgtcctcccaattccaactgtgacggatacgcaatgtcattgtctttaaattcttctctgtctgacatatacggcatacggaatacgcccacattgtcctccatatcggtcagttctgcgatcctccagcttccgtcaaatgacatggctgtctgtccgctaacaaacatggctttttccgtttcatagtcaagtcccaggtaatcttctccaaagattcctctgtctgccaggtcctgaataaatgcaatagtctccacaacatcttcatctgtccattttgcttttcttccgcccagttcttttgccttttccacaccgcacattttatagagaagcccggtctggatatgtaccacacgccatgcattggatgcccccaccacccatggcgtgacgcctgattcttttaatttatcgcatacttcatagaattcatcccaggtttccggtgttttctcaatccccgctttttggaacagttctttattataatagaagacttccatctggttgttaatgggcaacgcatatgttccctctgtccccacagaagacaattccatcatgtcgagaagtgtggcgtccacattgtctttcacatccggtgtctctgcaatcaaatccgtcaaatccagaaaaacacctgtatctgcgtattctttcataatactgatacccggccactggataatatccgctacatttccggatgcaatatctgtcttaaactggtttgtaaagctgttgctgtcattggtactctcatcctggatcgtaatacccggatatttctcctgaaactccttgagcacttcctctttcagcttggtaccgctgtcagcccctgacattcttgtgagaagccggatcgtgatcccttctccgctttcttttttgtcagaatccgttttccctgcttctccctttgcctctgtcccgcttcctgcatcctggcctttgccccctgtatccgactcattgctgccacatgcggaaagtcctgttactgccatagctgctgccaaaagtgctgcgattttctttctcattcctttactcatgatcaatacctccataatttttgctgtacccctaaagggcatttttatttatttcggatctaattcccatatttaatgaactttttcagcaccagggacgcagacccaactgcggtgccgttctcacccatctgagaaataactaacttcacctgccttcctgcaaatttcatctgcctctcacgaagcacttccttaattttctttaaaaatatatcacctgcgttagtcagacctccaaataatatgatcaggtccggatccagcagattaatataatttgccagcccaattccgatatactgcatggcgcgctctgtgatctggatcgccatttggtcccccagatgtgccgcttcaaatactgtcttcgcctcaatgcggttgatgtctccatttaccaattccattatttttgatgcattgccctccagcactgctatcttggcatctctggcgatcgcgtttcctgaggcaatggcctccaggcatcctttgttgccgcagttgcattttggcccgttcttttccagaatgatatgtccgatttccccgctgcttccggaacttcccctgtaaaattccccttcccgcataatagcagaaccaataccgtgacccagattcacaactaaaaaatttctggaatctactccggcgccaaagtaatactctcccatagccaatgcacggttggcattttcgattgttatatccatcttaaaccgctcacggatgggtgtgagcatatccacattctcccatttaaaatcaggagaaaacagaactttcccgctttcctcatccagaattcccggcataccgattcccattcctaaaatccgcttctccggcagaccgctttcccgtatcacattttctattacctggatcagtctggatatccatacctccggcaccactgtgccccctgtctccatgatctcacggataaaaacctcacctgcaaggttcatcattagcacatttgttttgctgcgccctacccccactccgataatatattttgagtcgggtatcagttccagtaattccgggcgtttccccccgctggattccccttttcccacatcctgcacaaactgtttatgagaaaattcctccgttattttcataactgtcggaatgctgaggccaatggttctggcgatctccgcacggctgatcggtccttttcttctgatcagatcaaagaccatgctccggttcatctgtgccattgcaaacttatcgtatttcactattctctgctcctcattaacttacttaatttaactaactaactgaataaaaaaaataaatatacaaaattacgacaaattattatttttcattctaatatgcgctctaatttactcttaattcaacagttacttaattaacttaactaactttatatgtgaattataacgtactgtttttcaattgtcaactcttttttgtgcgttttaacgtaaaatttaaaaatgcattattttattactgccttacaaaagacatgcttttgcgaatgctgacaaaagtgctgccgtaaagcctcaaaaagacattacgacagcttctgtgtccgtcaaagttcccctccgttttctataaacagccttatcagcatggcggcagcacctatggctgtagcgtattctcccagggtaccggtctttatagacacatttttcccggaatacctcattttgtatttttctactgtcctctgcagctggtccaaaaacaaatctttagattttgtgaggccgccggccagaatgatcatatccgggtccagcagattaatgctgctggctatggcgatccccacatactccattgcctcatctattattttccggctcagtatatcgcctgccctggcggcctcaaataccatctccgcctctattttcccctgtttaaccgctgccctgctgactaaagtctgctttccttccattatttcccgttccatccgctttgcaatggcgttcccggaagccagcgcctccagacacccctgattgccgcaatcacagagaggaccgtccggctccatgatcatatgtccgaattcgccgcaggtcccgcttttaccatagagcagctggccgctctcaataattgccgccccaataccgtatcccagattgatgcagaggatatagtccgcgttttttgccgcgccgtagatatattctccaagcgccagagcacggttagcattttccagaaagatcttgtaaaacgggagtcggttcctgaatatctccatcagcggcacatttacccagttaaagtccggggaaaaaataacgtctcccctggcgtaatccagaatccccggcataccaatgccgatccccataaagcgtcctttggaaatcccgctttttatgatcagagcttccacacgttcggctattttttccagaaactgtttcggttgtttaatgtcctcctccgtagtaggaaaacattcttttgacataatgacagccgccatatcgataatcacgattttcacgtaatggcggccaatatctattcctgttatgtaataggcatttgaaacgaattccagtaaatcaggtctttttcctcctgttgactcaccttttccgatagtttttaccagattctcccgttcaaattcctctgtgatcttcattacagtgggaatactcagctcagcctttcttgcgatttccgctttattgatggggccttgtgtacgaatcatttccagcactatcttcttgttcaattgtgccaacatagccttgttatatgacattctcttccctcgtttttctccctgatgtactctcgtaatctcctggtgtttttttccagggtttctacttcttttattttaatctaggctattcaatttttcaactgttgatttgcagcttctcttttgcgcttctcttttatctttccctgtttttacagatgaccgacagatagattctgccggtcatcataatacgtctctgcttctgttttcaggtttcccacttaaaaatgacaatgcctgcaatggccactgccatgccaatcagctttctccactcaaatcctactttttccaccccaaagacaccgaaaacctcgatcaggtatgccactgcaagctgtgctattacgatgagcatagctgcgcgggccggtcccagggaagacatactctggataaccgtaactgtgatgaacgcaccgatgactccccctaataaaatgtacttgtggtcaactctcgccaaatcggttatcttgtcccgtcctgtaaacagccaggcggctatgcagaccagaaatgccgatatctgcacccatcctgtagatacccataagctggtctgttttgtcagcgctgtattaaaaacaccctgtacgctcatcagcgcacctgacagaagagcaactaaaattccccacataaaaaatccctccacatcctttttcttactagaatgtcccaaaaaacaatttttatgtggatatgccgcaacaatctaataggtctgcgcatttcctgcagtatataaatacggaccatccgcatatggacagtccgcatcttttccgatttcatatatttaaaagcttttttctaatttttctatcatctcatccacatcccgctccgtgatcacaagaggcggcacaaggcgcagcacatcactgcctgcagatatgaccatcaggccgttctctatagcttttgacacgatttctcccaccggacggccagtgacaacaatcccctgcatcagtccttttcctctccttgctgtaaggaaatcgtatttctgcacaagtgcatccagcttctcttccaggtatgcggatactttttttacatgttccaatattttttcactctcgaacaagtcgaaaaccttgctgactgctgcacaggcaaaaggatttcccccgtatgtggttccgtggtcccccggcaccagagacttttctgcagtcttttgattcaggacaaatgctccaacggggacaccgcagcccagtgctttggcagttgtcatcacatccggttcgacaccgtaatcctggaacgcgaacatacatccggtccggcccataccacactggatctcatccaggatcagcaggatatcatgctcatcacacagagcgcgcacaccttttaagaattccggttctgccggatagataccgccctctccctggacggtttccatgatgacagcacaggtcttctctgtgatctgactctttacactctccagatcattaaaatcagcaaacttaataccgccgatcaacggcttaaacggttcctgataatgggtgttgcctgttacagacaaggcgcccaaactcctgccgtggaaagaatgcctcatggcaatgatctcatggtctgtatttttatctttcagccaggcatattttcttgccactttaatagccccctcaatagcctctgtcccgctgttggtaaaaaatgccttgtcaaggccggaagcttttgtgagcttttcagccgcttctaccatgggcacattgtagaacaggtttgatgtgtggatcactttgtcgatctggtctttcagcgcctgattatatgcctgattgttgtaacccagagcaaaaacagcaatacctgccgcaaaatccaggtattcttttccgtccacatcgtagagacggacaccgtctcctttttccagaactaccggaaaacggttatacgtgtgaaggatcacattctcggcacgttccatatatgcattactcttggtcttcatgataatatttcccctcgcctttccttaagattgctgttccgatccctttatttgtgaagatttccagaagcagacagtgcggaatcctgccgtctaatatatgtactctggaaacgccttcctcaatggcgtcaatgcagttctgaagcttcgggatcataccgccgcccacatttccgttttcaatgaggtttctcgcatcatttacgaaaagctctgatatgaggctggaagggtcatccgggtttctgtataccccttcaatatctgtcaggaatgccagtttctcagctttcatggaacaggcaatggcacaggcagcatcatcggcattgatattataggttgcgaaatcatctcccaatcctatgggacacacaatgggaagaaaatctttttccagcagatcgtagaggatctttggattcactgttttcacgtctcccacatatccgatatcctgtccgtcggaaagttttttgttgactgacaaaagaccgccgtcttttccgctgatacccacagcccttacacccagggactgtaccagagtcacaagttctttgttgacttttcccaggaccatctctgcgatctccatagtctcatcatctgtgacccgcagaccgtttacgaatttggcttcttttcccactttgcctacccagcggctgatttccttgcctccgccgtggacaataatgggtttgaaaccaaccagctttaaaagtaccacatccttgatgacatcgcgtttgagctgttcatccaccattgcgcttccgccgtattttacaacgatcactttcctgttaaaacgttgtatgtacgggagcgcctcaatgagtacctccgctttgtccagatatttttgattcaccatttccctatcctccgttactgttctgtgttattactgttctgtttgatttttgttctgtatggttactgctctatacgctttttgttccgtttcttttatgaccggtaatccgcgtttatctttacatagtcataggtcaggtcgcatccccatgccgcagcctgggcctctcccatcttaatatccgcaatagctgtcacttctttttctgacagtatctttgtggcctcttcctcgctgtatccggttgccacaccatcttcgattattttcagttttcctgctgcgctctcaaagtataaatccactttttcaggatcaaacttggcaccggaatatcccatagcgcacaggatacgtccccagtttgcgtcgtgtccgaaaatagctgcttttgtaaggtttgaggtgataatggatttgctcagggtcactgcctgctccttgctttccgcatggataacttttacctcaaacaatgcggtagcaccctctccgtccgctgcaatgtgttttgacagccaggtattcacatatccgagagcctctgtaaatttggaataatcctcatttttctctgtgatctctttattgcctgcctgaccgttagcaaggaggagcaccgtgtcgttggtggatgtatccccgtctacggaaaccatattgtaagtgtccttgacattgtcactgagtgcttcctgcagcagctctttgctaatattcacatctgtggtcaaaaagccgagcatggtacacatattgggatggatcatgccggaacccttgcacattccgccgatggtgacttttttaccgttgatctctgtctctactgcgatttccttcttcacagtatctgtggtcataatggattctgccgccagtgtgcctgccgcctctgtttctgagagcaggggaaccattttcttcacacctgcctccaggatatccatgggaagctgttttccgataacccctgtggaagccaccaatacggaatcctccgggattcccaggatcgctgctgctgtctgagctgtctttttgcagtagctgtatccctcttcccctgtacatgcattggcaataccgctgttgcagactaccgcctgcgctgctggtgcatgatagacgatctgctggtcccatttgacaggggctgcttttacaatattggtggtaaaggttcccgctgccctgcagggcactgtgctgtaaatcattgccatgtcctttgcgtttccttttttgatccctgctgcgatacctgctgcctgaaatccctgtgccgcggtcacaccgccatttattactttcatcttcttcatcctcctatcatttacgggaacatgggtaccagcttcagcccctctgtctcctcaaatccaaacatgagattcatattctgcaccgcctgccctgctgcgcctttcaccaggttgtcaatagcgcccatcatgatcacacggtttgttctgctgtcgatcttaaaattcacatccacaaaattactgccctccacccattttgtctgggggcacgcctctttatccagaagacgtataaaatattcacttccataatatttctcataagctgcgcggatggtgtcatagtctgcgtcctttgccaaggaagcataggcagtcaccaggattcccctgttcatgggtaccagatgcggcgtaaaattcaaacaaaacgctttgcctgccgcataccccagctgctcttctatctcaggtgtgtgccggtgagttgccacgccgtacgccttaatattttcattgacctcacagtagagattatcaatcttggctcccctgcctgcaccggaagtccctgattttgcgtcaatgatcagtgtctcaggccggatcagtccctcctttaccagaggataacaggtcaggatactgcatgtggtataacagcccgggtttgccaccagacgtgctgcttttacatcctcgcggttgagttcacagagtccatagacagcttcttcaatatactcaggagctttatgctgtattttataccactcctcgtacacttttacatccttcaggcggaaatccgcactcagatccacaatttttactttcgagagaatctcctcattcaccagagaagcacacaatccctgaggtgtcgccgtaaaaattacatccacttcatctgccagggcttccatattgtcatccatacacttatcgtctaccagtttgaacatgttctggtaaacctcgtagtattttttatctatgtagcttctggaaccgtaccatttaatttccacttctttatgatttaaaagtaatctgacaagttcgcctccggcataaccggtagctccgatgattcctgcttttatcatgttcttcaacaacctttctcaatgatcttgatattcattcgtgtctgcggcgctgcggccgcccgtgtatgcttttatcatactccagttattttgcatagtaaagctttatcctgtcaacaggattcgttactattcagcctttcggcttcatagcaacaaaagcatgcacacagactgcaaaaaccgcactctggcgcgtggctgtctcgggattgccttgcaaataccaggcaacgcctcgcgggacagtggaagtctgaactgttaccaggattctgcataaactgttcttcgattgcataatcatacatcttttctgtataatatgcaagcttttcttgagaatttttccagtttttttgttatataagttcggatcattccatatattaattaaggaaacttcctttttcaaaaatatctcccctaaaataattttacatttttttcattttcctattgcataaatataaaagatgttgtatagtaaagcatgtcgaaagcaaatacaaaatttttagtacatagaaaacggaaaatacaggaggaattcatcatgaaggaaaaagttatcttagcatattcaggcggactggacaccacagcgctgataccgtggctgaaagaaaattttgattacgaagttatctgctgctgtgtggactgcggacagggaaatgaactggacggactggacgaacgtgccaaattatcaggcgcttccaaattatatattgaaaacatcattgacgagttctgtgacgactacattgtaccgtgtgtacaggcaggcgctgtatacgaacacaaatacctgctgggaacttccatggcacgtccgggaatcgcaaaaaaactggttgagatcgcaagaaaagaaggcgctaccgctgtctgccacggcgctaccggaaaaggaaatgaccagatccgttttgaacttgggatcaaagctctggcacctgatctgaagatcatcgctccatggcgtatgacagatgtatggaccatgcagtcacgtgaagacgagattgaattctgtaaggcacacggcattaaccttccctttgacgccagccacagctacagccgtgaccggaacttatggcacatcagccatgagggactggaattagaagatccggctcaggaaccgaattacgacgacctgctggttctgggtgtaacacctgagaaggctcctgatgaaggggaatatgtgactatgacctttgaaaaaggtgttcccacaagtctgaacggaaaatccatgaaggtttccgaaatcataacagagctgaatgccatgggcggcaaacacggcatcggcatcatcgacattgtggaaaaccgtgtggttggtatgaaatcccgcggtgtctatgagactccgggaggaaccattttaatggaggctcatgaccagttagaagaactgatcctggaccgtgacactatggagaccaagaaaaaactgggcagccagtttgctcagatcgtatatgaaggaaaatggttcacaccactgcgcgaagctatccaggcttttgttgagagcacacagcagtatgtaacaggtgaagtgaaattcaaattgtacaaaggtaatattatcaaagccggtaccacttctccgtacagcctgtacagtgagtcactggcctccttcacaaccggagatctgtacgaccaccacgatgcggacggatttatcaccttgttcggtctccctctgaaggttcgcgctatgaagatggctgaagcagaaaagagccagaataaataagcctatattttcttttacttatattttatgccaaaggcagccgggacttttcctgactgcctttttgcatatcagaatccggaacagaaagatttacaggcacagtttactgccttttaattatgattgggtctgcatggatattatcgtaactgtgaatatacggaacagttccgataatatcatagatgataagatgcagtctgccggacgggcagattcccgcccggtactgcaaagaaatttatagatatgagaatttagatatgatactgttttaatagccgatccctgagttcaggatcttctgttataagcggtatctgttctgccttgccatcacggagaagaagcctgatcagctttgacatttgggccaagccctcttctctgccttcctgttctctgtccaacagtaactcctcaaatttcatatacttcgcctcccattcccggctctttttcagctctgtaacttgatcatggatcgtcttgatcaccgggtcatttgctttctccacaaactcgtctgtggtgttttccacatatttgagaaaatgcacgagttcaaggggtacatctggatcatttctcccttttgtgtttagaaatatcttttttgttccgtcattgaggggcatacctccggtattcctaaaaccaatgcaaacagaaacgcattgctcagatcaagctcctgaaaggtttcgctttttgccatatttgctcctatccggcagttatctgcggacggaaatctttctcttcctacctcttattatgaagaaaatgtgttaccttgtcaacggaaaccattcaacaaaaaaaccaatttttcaacttaaaataccaaaacccccggaataatcccaaggtcatttagacaaacagacattccctgccggtgcctctttcccagtcacgtccgggacgatgttcagcagcaccgaggcatagaatactcccgctttctgctcaaactgcgcggtcccgccataccgtacagcaatctcccgaacagagtaagttccaatcccggctccctttcgtttggaagacaagggcatgtccccgtcaaacacaacaggtgtcaggcatggattatccaccaggatcagaagtgccgagccgcctcgctgctttatccgaagcttgatggtctgagccgtgttcgcctgccgtttacaggcttccaccgcgttctctaacaggttccccaacagcaccgtgatatccgtgctggacaccgggcagttttccgggtaatcgatccccgtttcaaacccgataccgccatcctgcgccagagcagcataatagcagacgacagcgttcaccacatcgttttgacaataccgctcccgcaggtccgggggcagatgattttgatagaggtgaatataatcggcaaggcccgccttgtcgtcgcgctctatgtaagactgcaccgcagccagatgctgacggaggtcatggcgggcttttttcatttcctccatatgggaggtaaggctttcaaactgttttttctgcgccgacatactgcggtcagcgtattccagagcggcttccagctgcacccgtctgcgagaggtttccagcaccttcaaagccacataagacacatagcaggccccgaacagcatgaggtagcgggacaccataaactgccatgtggcataggcgtacacatcttcggtgaagcagtacagcataccgaacagggtgggaaacagcggaatgacccacagataccgccacatgatcctgtcctcgattttcagcgcatctctcaccgtatgacagaggaaccggaacacgaatgggcaggtgatcatgtagatcaccacacgagccatattgtaaaccaggtacgggtgcagttcggaaagcttccagaaataccggctttcaataaaattcgcattgccatacacaaaaaacgaccacgccatcatcagcagataagtaaacatcagctttgataagctctccttgatgagaaggaaggataacaccaggttgaccagcgtgaagccgtagcgcatgaacgtcgtccactgtgccgctgtctcatacccgcctaagttgatgtagtaaaaaaccatgctgttgactgccgcaagtataaccatcatcgccgtgatataccgaaacggaatccgcagcctgtcccggaacagccagtaccggggcaggccaaagggcataaaatccaggaacgggaacaccagcaccatccatgtgtctatcatatccatcatatcggtatgccctcccttctcctccaaaacaaccagattcttacgtattgatgcaggtgcttatataaatcctgcctgcatggtaccaaatcctctatcatggcggctctcatatggaaaagccctcctttatcacaaaatatatccctagggtgtgacgcacagcttgccgaaagcaattttcaaacacactctattcaagaccattttaccttaaaaatatgttatgactaatgctagttcaggccaaaaacttcaagtttaggccatcctattgaaaaaacagcctttgtttactctatggcaaagagggaaaaaaagccccgccagatgaagaatatctaatccagcatggactttctgttcgatgacccttgcaaagtcaaatattgtcagcaataagctttcaaagtaaaattagcaaaaaaggccgacaaacagtatttgtctgtcgacctggtaaacgtgatgcttcaaatatcatgctataaatgacatttggaataaaccgttcctttttctttaatcctcatccacatatctctgaatattggaggcattcacatatttttttgtctcctcaccattgatcacgatcagtgtcggagcctgcataacgccaaacttgcgggccagttcaggattcttttccgcatccaccagctcgtaatcctcaccttccagcatctgttttgcaatcttacagtttggacaggtttctgtggtaaagagatattttgccgtaacctgtccggcatctgactcctggatcctcacatcgctctctggcgctgccgtcatttgggtctggatcttgaaatcggaatgggcaatgtcatagaccgtacggttcttgtattcctggctttttccgtcgttccagttctgtacaggacggtaatagcctgtaatacggctgtaaacctcagcctttttgccgcatttggggcagacaaaatgttcaccggagagatatccgtggtctttgcagacagaataggttggtgacaaggtataataaggaagacggtaattctgtgcgatctttctcacaagtgcagcggcagccttccagtcaggcagtttttctcccaggaaggcatggaacactgtgcctgaggtgtacagagtctgcagttcatcctgaatatccagtgcgtcgaaaatatctgctgtataatccaccggaagatgggagctgttggtgtaatatggagtatctccctcatttcccgctgttctgatatccggccagcgttttctgtcatgctttgccagacgataggaggtggactccgcgggagttgcctccaggttgtatagatctccatactcttcctgataatctttcagacgttctctcatgtggttcagcacacgttttgagaactcctgggtcctctcatctgacatatcacatttcaaccacctggcattcagacctgcttcgttcatgcccagaagaccaatggtggaaaaatgattctcaaagcttcccaggtatctcttggtgtatgggtagaggccttcatccaaaagctttgtgatcacatctctcttaattttcagagaacgggcggaaatatccatcatatgatccagacggcggaaaaagtcatcctcatcctccgccatgtaagcgatcctcggcatattgatggtcacaacacccacagatccggtactctccccggagccgaaaaatccgcctgttttctttctcagttccctcagatcaagacggagacggcagcacatacttctgacgtcactcggctccatatcactgttgatataatttgaaaaatatggtgtgccgtatttggatgtcatctcaaataacagcttattattctctgtgtcagaccagtcaaaatctctggttatggagtaggtgggaatgggatactggaaaccgcggccgtttgcatcgccctcgatcatagtctcgatgaaggctttattcaccatatccatctcttttttgcagtctttgtacttaaacgacatctcttttccgcctacgattgccggaagctctgccagatcattgggcacagtccagtccagggtaatattagaaaatggtgcctgggtaccccagcggctcggtgtgttgacaccgtaaataaaggattccacacatttcttcacttccggataactcaggctgtcggccttgacaaagggtgccagatacgtgtcaaaggaagaaaaggcctgtgctcctgcccattcattctgcatgatccccaaaaaattcaccatctggttacagagtacgctcaggtgcttggccggagaggatgtgatctttccttcaatgccgcccagtccttctttgatcagctgttttaaagaccagccggcgcagtatcctgtcagcatggacagatcatgaatatggatatccgcattcctgtgcgcctcagcgatctctgtgtcgtaaatctcggacagccagtaattagcggttacagcaccggaattactcaggatcaggcctcccacagaataagtcactgtggagttttcctttaccctccagtcttccactttcacatagctgtttacgatctctttgtagtccaggatcgtagacttcatattgcggattttttctctctgctttctgtacaggatataagactttgccacatcagagtagcctgcctggatcagtacattctccacgctgtcctggatatcctccacagaaactttcccctttacaattttcttctggaaatctgatgtcacacggagtgccagcagatccagcatgtcactgctgtattcattctccgtagcatcaaatgctttcttgactgcttcagcaatcttatccagacgaaattctgcaatttccccatcacgttttactacctgaaacattccttttcctccttatatgtaaagaagcaggaccgtcttgccgtcccgcctcgcattcacagagtatggcctctgtataaacgctgtaggtctattgtagcaaaggttatacttttcgtcaacagtaaaaactaccatatattgtaaacattctttgaagtttccaatatatggtagtttattaatcaaattattaattccggtctttgcatttatctgcctgcagactgcaggaatgacagcctacaaacgtccgtagatgtccttcggaacccttgcttttactgcgatcccgccgtctgtgtactcctcttccataagctgtccgtacttcctgatctgctgcaggatccccgcgtctttataagggatcacacgctccagataaatctgatcctctgtcacgattttttccagcacatccttaagctgttccagtccctcccctgttttcgctgagatgcgcagcacatgatccgcattgggatctctgaggatctgttctgtcaaaagcttatcctgcttattaaaaagagtaaccatctttttattggtcacttccagctcctggagggtgtcatataccactcccatctgatcttccatctggggattggacgcatccactacatgcagaatgatatccgcatattttgcttcctccagagtgcttttaaatgcctcgatcaggtgatggggcagtttccggataaatcctacggtatctgtgaggtaaatcctggttcccccggaaagttccagcattctcgttgtgggatccagagtggcaaacagtttgtcctccgacaaaacacctgcgtctgtgagtgtgttcagaagagtggattttccggcattggtgtatcccacgatggcggctgtcatgacccgctctcttttcctaccctcccgaagtaattctctgtggcgctttacctgttccaattctctcttcaactgggagatccgctctttgatcagacgtctgtccatctccagcttcttctcaccgggtcctctggttccgatcccgccgcccagacgtgacagggaattccctagtcccacaagacggacagcccggtaacggagctgtgccagttccacctggatcttcccttcactggtggacgcatggtctgcaaaaatatcgagtatcagaagcgtcctgtccatcaccttgcagtccagttcctgctgcagattgttcatctgcaccggtgacagctcatcatcacagatgattcctgtggcgtccagcgctgtgagcagcattttcagctcctccatcttgccttttcccacataggtgccgggatggatccgctctcttttctggatcacagtgcccaccacctgcgcgcctgccgtcttggaaagctctgcaagttcttccacggattcctccgcgtcctcaccgtccccctcctgtacccccaccaggataacgcgttcctctacatcgttcaaatcgtataactgcataaatatctcctataataagccgtattaaaatccgtataaataaaactgtcctatcatcataacgctttttctatacgctgacaaggggacatttttcacaaaaacgttccttctattacaggcagaccggatacaactcatatacactcttttttctcatatattttcattgagatccaaaaggataaggaagtaaacgcgatacaaaataccccaaatcccaccactgctatattctgattctgtctcagaaattctgtcatggaagtaaaaagggaggagcttgcaaacattgaactggcaaaccccaggatcactacagtacccgatagtaaatattgaacctttatcactcctaccttatatacaacaggaataaatatgcccatcagcaaaagataaacggaaaatacctgcatgatttgccatatatataatatctttccgctcatgaccagaccaaccgcttcatatcctgctgcgcaaagcaaaaaaaacagactcatcaccagatatctcacagccaccagcattttcctggaacagggcgcacacaacagcgcgatctcaccaccgggacatttttcttcctctgtacatatatttccaaaaaggatcagtcccagtatactggacatcagcaaaagggggactccgcccgcatccatttttgtatcgactctccaaaaaagaaaaatcggcataccaatgatcatgacagccataacagcaaaatttttcctgatcagcctgatatctttcataaacagcgctcttaccatatccctagctctcctttcccatacatgacatcagaatttcctccatatccggcttctcaaacaatacatccggaaccagatgtctcatttcctccactttgttcgtgacaccggtaaatccgtattttgttttccggaggctgatacacaattcttctgcctcacggctcaaatccctgctgtccccctttgctatcctgtattcttccatcagaacatccttctccttctggaatacaattctgcctttttcaatgagtatcacaatatccgccaccttctcaatgtctgtggcaatatgagtggaaaaaaatacacctctgccttcccgctccatatactcccgcagactctccaggatctgtgccctggtaagcagatcaagaccgctggagggttcatccatgatcaaaaattccgcgtgatgggacatggcaagagcaagggcgaacttcaccttcattccccttgacaattcctgtatcctctgcttctcattcagggaaaattttttgatccagcccttatataccgagtcatcccagttcctgtacagggaagaaaaaagggaggctgtttcctttaatgtgaacattccgtaaaaacctccgctgtcggtaactacaccgatgcggtttttgatctcctgttccctctcctttttttcattcatatccattcccagaatctgtacctgaccgccgtctctgtggatcagattcaaaatggcacgtatggtggtggtcttaccggcaccgttatttcccacaaatcccgcaatacagccctccgggatggcaaagctcacatcctgaagctcaaatctggtatatttttttctaagacctcttacttccagcacattatccatttccaatctcctcacttaaaatgtcgatcatctccatgatctcctctttactgatatccagcatggaagccagtttcagagcctcggtaagcttttcctcgatcattcttcgcttagactccttaaaaagctctgtattccctgcctttacaaaagttcccactcctacctggctgaccacaaatccttctttttccagttcctcatagactcttcggatggtcagaacactgaccttgagatcattggcaaaactgcggatcgagggcagcagttctccctcctgtaactctccgctcagaatactctctttcatctgctccatgatctgctggtacagaggttcattggcagtgtttgatattgttatcttcatgtttcacccctttagtgtgtatctctatacatcacactatacacttacatatcactcttgtcaatagcaggacgaaaaaagctgctgaaggtaacggttcagacaatctgaacagttaccttcggcagctcaatacgattcgtttatgcttcaagatccggttgatacagtcttatgtttccttccaacttttccactctccactgttttttgccaaagggcaccgtgagagcaaaccgtcctatggaatccggaatgtgaggttcaaatcgaaatcccttctcctcttttgggtcaggacgtatccccgccagttcttctatcaaaatactgatgggcgcagatgcccagggatgacacaggctggtattccatttctgttcctttccccatgcctcaaagcaggtgtcagccccttcccgcagcatgttgacccagccgtgctccccttcattgacaagaagccggtatacaccttcatagcgtccggccttcccaagggctttcagaagaaaaaagcttggcataacaccgcagcaaaatccctttttctcaagaaaatctcccacgcactccaccgcttcctccggcaccagatcaaaatacagggcgtatatattggagtgaagagaacaatgtacactggtttcactgtcggcgaacagttttttatccggcctgtagaacgctttgatataagaccccctcactttttcaaaggaatacgagacaggcagacccaggatcctttctatttccgtcaaagtctttatggcccctgcatacagggcattgatgacattgtgacagccttttgccactatgggacggctcaggataaaatcataatcatcccgcaggttttccggccagtccaccagattccatttttctgacacctgatccagcaggcctttttcatcctcatatccggtaaaataatgtacaatgcctttggcagtctcataatattttctcaaatattccctgtcccctgtaaatacatgatccgtcagcaaaagctgtgaccacaacagggaaaaatcagcgatctcctgcataaaagccccgggagccacagccattagacccgggcagatcttctctgtcagggcaaactggtcaatacattttctcagcatatcagtctttcctgtaagccacacatgggaacgtgatgtgataacagcatcccccaaatactgtcccttctctcttgtgggacagtcaagatatgcctcctgcgtgccgtattttactgcatttttgcagatagaaaaaatgcccgccagcttttcatctgtagtcttcaatgtgcacagagcatcctccatggggtaatggcgtacctctgcgcagacctccaggatctccaccctgcttccaaagcggatttccccataacgaaatcctttataatcatatggttccagctcacatataccaccgtccagtgtccatatctcccggtaacagcagccgcagcgcatatcaaagcggacactgccgtcctcctcccgttcctccccacagaggatctccaccttctcgccgggagggccggaggcttttatacacaggctccctgtgatctcccggcctatatccacagaccagcagccctcctctttttttatcacctccggctctcttctgtatactgtcagcatttccgtgggctgtttgatcagcttgtagtccgcccattctgccgcttccattggctcccaccggctgtcatcaaagtccgcgagattccagccggcatcccagcgcctgctgtcaaaatcctccagaaattgtgtctcatatccaatggtcctgccggaataggcctccgatattttatatctccacataagggggagcacttcttcccctgtattcccgcagacaagctgcgcggccagggcaaaccgcccgtctccgctgttccagacacggttcacaagtccctgataatacagatgcacagctagcacattttttcccggccggaaaaacggggtgatatctatctcattataatagtatttctccggccacgccggggccggtccctgtccggcaaaagtgccgttgatccagagcttgtagtgatcatctgcagatatgcgcagcagatatctttgtccgtccccttctgcctccacgtctgtccgggcaagtacatgcagattttttaccggaaattcctcatgatcacagttctcctgttccttgtggtaaggtgtttccggttttatgcaggcaaactgagggatggtcagccagtccggttcaaattttttcataagtctcactcctgtcgattcgctgaaagtttttattcatccatatgctatatcttaatgcattccggattttaagtacatgtaactttttttgattatatgtactatttcgtaacagttcagccctccactgtcccgcgaggtggatctatggcataacgcgtacgttctcataaaaccgcctttttaaatgaaaggtaagcgctcagacaatagatcaaatagatactgaagaagacacctgccgtcatccccagaatgcccatgccctcaccaaatcctattaaagtcattccctgatatgcgtcccagtttatgctgcctgtgattgccatgtacacagcagcaccgcctaaagcggcgggaagtaccggaaggaaataatagacggcaaaatacctgcgcaggatcctcctctgctctgactgatccatcccgcattctcccagtatggcaaactgccgcctctcctgctccagatcactcaatatctgtacagtcatgatagttgccgcagccgccagaaagataaatgccagataaaacaggggaaaagaaaagctcatgacaacagaagccccagtctcccgaatctccggcttgccggtcagatacgtcctatccccccgttcaacagacaaaagtccctcataatcttccatggacagctcttttggcgtcacccccacatacagttcctctatcacctgcatatgctccaccgcccagtccggcacgatcaaaagataataactgccgtttccgaagaactcctgctgaaaaaacgcgcctgtgaatgccccgccgaaggaaaggatctcatcctctttgccattcacttccagattccggctttttgcataccgctccagcttctcttttgcaaatccgctacagtgcatataatagctgtcctggtcaagatgcaccttttccatccccagcatatctctcaactgctcatatacggacattttcatatagcagtcattatccatggcatccatgtgggaaaatcccataaatttccccatattttccgtagaaaaataccggccaaaatcccgttctccggaggtgtagatctgatactccccagtgacagcctcaggcagtttactctgtgcatattccttaaaaagtgtcaggtcctcctgcccgtacagggaacctgcggcaaagtcaaaggctgtctcctccaccctgctgtccacacgcctgttaaaaaacaggcccaggctcactgccagaaataccaacaggaataaaatgctgacactggctaacgtcaaactgagattccgtatttttcctgaaaaaatgcgtcccaggacaagatttctgcctctgtatttccacttcactctgtcaagcctctgttccaggactgccggaaatcccataaaaaacccaaacacggacagcacgatcataacaaggcccagcaaagctaccgcccctcctgcatcattacccacttcactaaaaagaagcgccgcaagcaagacacagccaagaaacagggcagatatggacaatagaaaaagaatcctcttccgcttcttattctgcacaggcgctttttcgttctccgcgtccatggagagcagttcccgaatgctgaccgccatcaccttcttttttatccttttccctgaaagaccaaatatacagaacagatacacaccagtcaggcaaaacgcctcccaggatacatccaatcccatatggaaaggccgcagaagcaggcgcatgaccatggcttttaaaatctgataaaaataagtgcctcccaccagccctgcgatccatgctgccactcctatcattctgctctcacgggcaaacattttagcgatctcccgattttcaattcccagcatcatgtaggttccgaactcccggctccttttcctgaatataaactccgtgatatagctcaccagtcttcccaggatcagtacaatgacaatactgatgaaaataatgataaagggcatcatagaccacgaacccaacacggccttcacttcctctgaaaataccagcaggtgaaaagaatacatcagtgtcacagacaggatcaatgtcagaagatacaccatataatcctgcatctgccgaaacgcatttctccttgacagctttttcagcatgatacctcacctcccagaagggactgtacctgcaggatctcctcataaaactcccgctgttccttttctccccgcacgatctcattaaaaatccttccgtccttcaggaaaagaacacgtctcccaaagctggcacaataggagtcatgggtcaccatgagtatggtcacctgcagttcccggttcagttcctccaaaagtcccataagctgcctggagctgcgggaatccagcgccccggtaggctcgtctgccaaaaggatcctgggctttttcaccagtgcccttgcacaggcacacctctgcttctgtccccctgatacctgataagggaatctagatgcgatctccgcaattccaagcctctccatcatctctacgcttttagcgtgcaccttttctgccggcattcccagcaggaccagaggcagggcaatattctcctcaatagtcagacggtccaggagattaaaatcctgcaccacaaaccccagattttccctgcggaattttgcctgtgccccctgttccaccgcagtgatgtccataacgcccaaagccccctgctttcccgtgttcagataaatatgtcccgcactcacacagtccacagtggaaatacagttaagcagcgttgtcttgccggagccggaggctcccatgataccagtgaactcaccttcctccacctgaaagctcaggccgtccagtgcttttttcagattctccttcgtgccgtaatatttttctatctgttccgctctcaaaacctctgtcatcttttcttccccgcctttcttcttaaaatgcaaatgcgcatacctgccggatcgctgcattctttttacttttctattataaagaaaatgaggccggaatacctgtgatcttaccgaatgttatcttacactttcgtaagatggaggcagatgttccgtttgtattgctgtgggcatttcaaatatgatccttgtatactccccccatactgactctgcccgtacagccattcccagctttttacagagttctctgcagatatacagacccattcccgtagactccctgttttttctgccattgctgcctgtgaatcccttgtcaaatattctccctatttcactgtcccggattccgcatccattatcctccacagacaggaacacagtgctctcgttttgtttggcctctatttttatgcagggagattcccccatatatttcagactgtttgacaatacctgccgcagcataaaggtcagccacttactgtctgtactggcttctgccttaaggccctctgtctcgatccttacgcctctctgtctgaaagtctcctggtctgccgctgcagcctgtgccacgcaggaatccattgaggtttttcgtatgatataatcctgttccgggttttccatccggctcatatagagagcctgctcaatctccctgtctatattttccaggctttttaagattcggcggttttctttctttttatcattttcacatatgagctgggctgaagtgaggggcagcttaacctggtgtacccagttctccacatattcctgataagctctgcgcctctgctcagcctcaaagacctgctcctccatggccttcatggaaatcttcatggtctcccagtatttctttccctcccaggtatccggggattttaaaacctctgtgaccagccacggtttttccatctccctgacggtctctataagctgtttaaaatattttctctccctgtaaaaagaaaacccggtccaggcagcaaaaatcccgaaccaggtgatcagaagcagcgctgcttcccttgtctgtactccaagcgccgtcaaaaaaacaaaaagtgcccaggctgctcccagctgcagaagcaccacgcctgttttgtctcctaaaaactctctgaatttcataccttatatcccatccccctctttgtctgtatcagaccgggcaggcctatggaggccagcttctccctgagtctgcgcacatttacgctgagtgtgttgtcatcaatataaatctggttttcccagagatgatccatcagttcctcccggctcacaacatttccggcatgttcaaaaagcctgcacagtatcttctgttcatttctgccaagctccagactcttttccccataagtcagccgggcagcccccagatcaagggtgatgccccgatattcgagaaccgcaggcttttccggtcctttggttctgcgcagcacggtctgtatccgtgccagcaggatcggtgccttatagggttttgtgataaaatcatccccgccgctttgcagggcttccagttcatccatggaagtgctgcggcctgtaaggaagatcacaggaagtgaacacacggttctgatctccctgcacaggacaaatccgtcctgccccggcagattaatgtccagcaggatcagatcaggccccgtctcttctatgatatccctaacgcttcctcttccgtcccagaaaacggccgcgtatccctggtttttcaaaacagaggacagaccccagccgatctcttcctcgtcctccacgatcaatatcttatccacgttctgtcctcctctgttacaaagccccaggcagaaccgcctttagcggtggaattcctgtccaggcactgaactgctgcttttctctttataagataaaagaacagagtatactcacatactctgttctgtaaaatcggaaatccggcatttctctaccttgtctccagaaaataattttctttcactgccctttcatctgtgggatatgcctccagataagcagcaattttctcttttgcggacgcatagtccattttcttttcataggccacgatttcattgaacagaagtgcctgtctctcgtcctggtctcctgtatccagtcccttctggatattggagagggcactgtcatagtccccgtccaggatatcacagtaagccataccgttgtaagcttttgcctgcagtgactgttcactcaggctctctttataattggcccgggcattggctgtatctccctgttccgcatataccttgcccagataaatggacgcctccttatatccgtcgttgtaggatgtggtcagctccttcttggcctcatcatactcctccagataatagtagacacggcctctgtcgtagtggtcctgttcatcgctgccctcaatatccagagccaactccagataggactccccgtccgccttcatgtcacactcttcgtacacacggtaaatttccagatagtcattgtactctttagaatccgccaccacttttccaaagtcggaagcggccttgtcatactggtctaaatgaagataggcagttcccctgaggaaatatccctctttactgttcttcacatccagcagctggtcgcaggtggccgcacttccctcaaaatcgcctctctgatactgtactacggccagataagccagtatatcggctctcagggccttctccgaatcagcagccaggtccctggctttttccagggcctgctgtgcctcctcgtattttcccattttcagataggcaatgccctctcccctgagcgcctccacctcatacttctcctcagcgatggccagttcaaagttttctatggcactctgatagtttttcccctctaaatcttccgcacccagttcataatagctgggcgtctctttttggcatcccgccataaggcagaggatgcatcctgtcagtacaataaattttcccttcacaaataagttccccgtctgcttactgcacgatcagattctcagacctcatgacagcaatcactctatctacattttcttcacagatttcattggaagctgcctccaccataacgcggataacaggctccgtaccactttcacgcaccaggatccttccgtcatctcccaggactttttccacctctgcgatggcttttatcacttccggattctctctggcttctttcttatcatatacccgcacatttttcagtacctggggataaatcttcacttcttttgtcagcacgctgaggggctgttttttctctatgataacttccatcagtttcagggaagtgagaattccatcacctgtggtggcgtgttttgagaagataatatgtcctgactgctcgcctccgatggaatggccgtttgccatcatattctcgcagacatatttgtctcccacggctgttttctcatatgcgatgccctctctctcgcaggctttgtaaaggcccaggttggacatgatggtggtgacaatggtgttgttgtttagcttgccctgctcctgcatgaatttgccgcacacatacatgatcaggtcgccgttcacttcctcaccgttctcatccactgcgatacagcggtcagcatctccgtcataggcaaagcccacatccaggtggttttccctgacaaagtttttcagctcctcaatatgtgtggaaccgcagtttgtattgatgttagttccgtctgggtcattgtggatcacataggtcttggctcccagcgcgtcaaatacgctcttcgcaatggcagacgcactgccgttggcgcagtcaagtcccactcttttattcttaaaagcacgtgtcggaatggagatcagatagccgatatagcggtttcttcctgctgaaaagtcaacggtacggccgatatcttctctctttgccagcggcagctccggtacctttccgtcaatgtaggcttcgatctgctcctcaacggatgcatccatcttatgtcccttggcgttgatcagcttgatcccattgtcatagtaaggattatggctggcagagatcataatgccgcagtcaaacttctctgtgcgaacaacataggaaacacttggtgttgttgtcacgtgcagaagatatacatccgcgccggatgctgtcagaccggcaaccagtgagtattcaaacatatagctgcttcttctggtatccttgcctattacgatctgagccttatgttcctgtccgaaataccatcccaggaaacgtcccactttaaacgcatgttcaactgtcaggtttacgttagcttccccgcggaaaccgtctgttccaaaatattttcccatatctgactccttatacaaatattccatttttttgtcttttcgttaccgtattataaaatatcatatttccggctatttgtcactgttattgcaaaatctttatccgcctgctgatgtttacagcggtgtattttccggccctgctccattatgcgtataaattttccgcgtaaacaccctgcctcaccagatctgaaaaagcctctgtcactttttccttgtcctcctggtatgtaacgccaaaccaggtgtcatgtgactttaaaactgccacatccgctttctgctctttgatgagtttatccacgatcgttggaagcagatattcttttttcagatcctcaggtccgcattccttcaaaaactccacaaatccctcttccagagtctttaagaatgcaggtgtcagtccccacatattcatggataccagatttttggggtccagcatacgcagacttttgtcctcattctccactgcagggccttttgctgtctttttaatattataggtctcagcaatccccaccagatttttattatcatccagggaacagatacctcttgtcacagaaccgttgtcactcaatgtgttctccaggataaagcctgccatgcagatatccagctttcctgtgtcctgatgctcttccaccagatagtcgtggattttcacataggcttctttgccgtagtaatcatctgcgttgataacaatgaacggctcagagagcacatccttagctgccaggatcgcctgaccggttccccacggctttgtgcgcttttgcggacaggtaaagccttcgggaaggtcgtgcaggtcctggaatacatattccacctctgctgttttttcaatcctgtttccgatcacctcacggaactcttcctctatatcttttctgatgataaatacaatcttgttgaatcctgcctccagggcatcgtgaatggaatagtccatgatgatctctccgctcggacctacttttgcgagctgcttgattccttttccaaagcggctgccgattccggctgccatgattaccagtgcagtttttttcatgatttttctcccgttcctcattcctatattctatatgttcccggccagcctgtctgtatgtcaagccggcagtataccaattaccacttttaccaaaaaatacttacttccataatatattacaatttacagggaaatgcaatgtcattttccttatggtaacaggaaacctgcccttatttttcaggaactattcctgattacggtttctattgtatcatagatatgctgtcatacacaacctggaattcccgtatgagtacgtttttcataacagttcagactttcaatgtcccgccaggtgcggccctgcatttgcagagcaatcccgaagcagacacgcgccggactgcggcttttgcagtctgtgtgcatgctttttgctatgaaggcgaaaggctgaataggaactgtttttcccctgctgccgtatcgataaaatcccccttatcagcctattacagctaataagggggatctattaccacaacacaagagctgtgctctcaattatttttcattcatcttcgtcagctttgccgcctggtccgcagcagtcaggctgtcaataatttcttccagatcgccgttcagcacaccatccagacggtggagtgtcagcttgatcctgtggtcagtcacccgtccctgggggaagttgtaggttctgatcttttcagaacggtctcctgtacctacttggcttcttctggattccgcttcctcgtcgtggcgcttctccagttccatctcatacagtctggaacgcaggacctttagcgccttgtccttgttcttgagctgtgacttttcatcctggcaggagatgacgattcctgtggggatatgggtcagacgcaccgcggagtctgtggtattgacacactgtccgccgtttccggaagcacggaacacgtcgaacttacagtcattcatatcaaggtggaaatcaatctcctctgcctccggcatgatggccacggttatggttgaggtatggatccgtccgccgctctctgtctcgggcacacgctgcacccggtgtacaccgctttcatacttcagcctggaataagcgcctcttccgttgatcataaaggtgacctctttgaaaccgccgatgccgttctcattgagactcatcatatctgtcttccaattctgggattctgcaaattttacatacatgcggtagatctctgcggcaaaaagtgctgcctcatccccgccggcccctgctctgatctccacaataacatttttctcgtcattggggtcttttggcagaagtaagatcttcagatcacgctccagctcctcgatgcgcttcttggcatctgaaagctcttccttgagcatttcccgcatctcagggtctgattcttcgtccagcatcataaggctgtcttccactgtctgcttacagtttttatattcacgatacgcatccgctatgggctgcaggtcgctctgttccttcatcagcttctggaagcgcgccgtgtcattcgctacggtaggctcatttaattcatttaaaatctcctccaggcgaatcaaaatatcatctaacttatcaaacatggtgttcctcctgtttctttcttcccagcaccacccggtcaaggcctgccaggtctttcactactcttgtctcttcatatccggcgttttccagcataaggcgcaccgggccgccctgatcatatccgatctcaaatgccaggatccctcccggcttcagatatcccccggcttcatgggatatcttcctataaaaatgcaatccgtccgtggttccgtcaagtgccattctcggctcatggtcccttacctcctccatgagactgtcaatgacatgactctctatataaggggggttggagacgatgatatcatacgtctcgctgatatttgaaaacagatcactcttcttccaaacagccccaatccccagctccctgctgtttctctccgccacagaaagggcatctcctgacagatcggcgcctgtcccctcggcatctttcaaaacggacaaaagagccagcaaaatgcagccgctgcctgtgcacatatccaggattctgaatctgctgctgcctgcctgcatcttcccggcttcgaggagaacctcctcaaccagaacttccgtatccagacgcggggtgagcacacgctcatccacatagaatttcagtccgcagaaccaggcctcatgggtgatatgctggagggggatatgctgcgcccgcctttgtatcatattcctgtaactctctgcctggtctttcggcatttcctctgtctccctcagaaaataggaagcccgcgtcatacctgtcacatattccatcagaagccacgcatctgccgtatgatctgcaatgcctgcctcctccagtatctttcttccttctaactgaagttccctatacgtctgcataacagccctctcctgtttcacatctgtgtgaagcagcagtctgccccagctccgcctgcgcgatttcctttccggcatccggaaaattctccagaagatatgctttccagtcaaagactgcctccaccgctgctatggcaacctccgccatatccggtgtaggttcttttgtagtcagcttctgcatggccataccgggcttggaaagagcacacacaatggtattctcacttcttcccgccagacggatgatctcataggaaatacctgctatcaccggcaccagcagtatacggatcacaacgcgcagccacatggtatgtaccggtacaacagcaaaaaatcccagaaagaatataatactcacaataataacaaaaaataaaaagctggttccgcagcgtttgtggagtctggaactttccatgacattttccacggtcagtgcttttccatgttccacacagttgatgcacttgtgctccgccccatggtacatgaacactctctggatatcctccatcttggagatcaagagcagatatcccaaaaagagcagaattctcacaagtgcctccgccagagtcacccctgtctcagacgctcctaccttatgaagcaggctggcgatcagatagggcagtaccataaaaagaccaatggaaaggacaactgaaaatatcacggttcctgtcatcaggatattttccatcttcttctgctttgcgtcgtatttttcccggtcttccttgttcagagcttctctcttcctgatctcctcctcttcctcctcaaagaacgtggcagagtacatcagacattttgtacccaccaccagggaatcaataaaattgaacacccctctgataataggaagagaaagaatttttttgttcttgataaaactcttgtagtcttctatcttaacttcaatctctttatccggctttctgacagctatggaatactggtcctgatgacgcatcatgatgccttccatgaccgcctgtccgccgatgttggatgatttcatctatacctccataaaatcccgatcccaaaggctgctcttgcgataccaaagcagagagactgcccgggagatacaataagaggctgaagtcctaaaacctcagcctctcccgtttttttatttgtccatgccgtattttttgttgaacttatcaatacgtccacgagcctgtgcagctttctgctgtcctgtatagaaaggatgacatttagagcaaacttctacgtggagttctttctttgtagaacctgttttaaatgtatttccacagttgcatactactgtacattcctggtagtttggatggattccttctttcatctttttcacctcttctatcgtttgttatttatctttattttgcgttttacaaattcaaacagcttttaaattatagcatatgatttttataaatgcaagtattattatagaaatcgttgttttttcactgtctgcacaaattcgttgttattgcgggtatgtgcgaacatattcaggatgttttccagggcgtcatccgccttcataccgttcagggctttgcgcatgatatccactgcttcatgctcttcttttgtgagcagaaggtcctctcttctggttcctgatttggcaatatcaatggccgggaatacacgtttctcctgaagtcttctgtccagcaccagctccatgttgccggtacccttgaactcctcgtagaccacatcatccatcttgcttcctgtatccaccagggctgtagccaggatggtaaggcttccgccctctctcatattcctggcggcaccaaagaaacgcttgggcatatgcagggctgccgggtcaagaccgccggacagggtacggccgctgggcgggactgtcaggttgtaggctctggccagtcttgtgatactgtctatgaagatagtcacatccttcttatgctcaaccagacgttttgcacgctctatggtcatctcggaaactctcttgtggtgctccggaagctcatcaaaggtagaatagataatttccacattcggtccctggatggcctccctgatatcggtaacctcttccggacgctcatcgatcagaaggatgatcagatgcatctccggactgtttttcaaaatggatttggcggcgtcttttaaaagggttgtcttaccggcttttggcggtgatacgatcattcccctctgtcccttgccgatggggcttaccagatccacgatccgcatggcaaggcttccgcccggacgctccagatgcagtctctcattggggaatatcggtgtcatatcttcaaaattgagcctacgcatctcattgggcttgatcccattgatggaggtcacgtacagaagggcagaaaatttttcattctggctcttcactcttgtattgccccgcaggatatccccggtcttcagattgaatctgcggatctgtgagggagacacatacacgtcattttcacccggcagataattctcacttcggataaatccgtatccatcgggcagaacttccagaataccacttacactcatgccgctgtcaagatccgactgctccataggaggacgctctgtacggctctcctgcctggactcctggcgctcttcctgacgattcgatgctctgctctcctggcgttcttcctgacgattcgatactctgctctcctggcgctcttcctgacgattcgatactctgctctcctggcgctcttctgttttgcctgctcttgccccgcttctcgactcctgctcattttccctgggggcactgctctccttcatctggcgttctttctcgtcttcctggaccatgcgctccacgagttcactttttttcaaggtggaaattcctttcatacctctggccttagctatttcttttaatgcccccaaagacagggactcatacttttctctcattatactgatcctttctttaaaaatctgtagctgtccaatacactcacggctgcggacaaaaatcgtaacaaatgggtaatcgtctgattcgacatgaatagatctatgaatatttccgtttcttttttaatcctatcatactttctggaaaaaagcaaaagaataatatatcttattgtcatcttccctttcttattttataatataaaaaaagaaaaggagactgaattttatgaaatttcaaatgatacatgaaaattataacgtagcagacctgtcacgctccctggcattttatgaggaggcactggggcttacggaaaaacggcgtatcaccgctgatgacggttcctttatcatcgtgtacgtgggaaatgagacaacagactttgaattggaactgacatggctccgcgacagagaagagccgtacaatctgggtgacaatgaattccatctggccttccggacagataactttgaagaatcccacagtcttcatgaaaaaatgggatgtatctgttttgaaaatcatgatatgggcatatatttcatctcagacccagacggctactggctggaggttgttcccgccaaatgatccccaatgcatgggagagatatcccatatttcaagggctgctgcatcaggtaaaacctctgatgcgcagtccttttattgagtaacagttcagccttccactattccgggaggtgttgcattgtatggggagctgccggcccccgcaggcaggatcttcctgccaacgttgtcaagttcatgttaggtcagttcatgccgatcctgggaacctcctggccccggagaaggattctcggaccgccggtgtgttcaatatattccttagtgattatcacttccccaatattctcatccttgggaatttcatacatgatatccagcatgtattcctccaaaatagcgcgcagcgctctggctcctgtgtgtttctccaacgccatcttagcgatggcgcccaaagccccgtcgtcaaattccaacttcacctcatccagtgccagcagtttctggtactgctttaaaatggcattcttaggctctttgagtatctgtaccagcatctcctctgtcagcccactgagtgtgaagattatgggaagacgtcccaaaaattcaggaatcattccaaacttcttcagatcatccacaataaccttatccaatatattggcatcatggtcgtacttatccttcagatccgcgaagaagccgatggatgcctgcttattcagacgctccttgataatattctccagatccggaaatgccccgccgcagataaacagaatgttccttgtgtccacagtggtcaggggcaccatggcattcttgctgttggctcccactggaacctccacctcgctgccctccaaaagcttcagcattccctgctgtacagcctcaccgcttacgtccctctggtttgtattctttttcttggcaattttatcaatctcatcaataaatataataccgtgttcagcgcgctccacatcattgcccgcagccgccagaagcttgctgacaacactctcaatgtcatcaccgatatagcccgcttcggtcagggaggtggcgtccgtgatggccaggggtacgtccaaaagtctggctaaggtcttcacgagatatgtcttgccgcttcctgtcggcccgatcatcagcatgttggacttttcaatttcgatatcatcttccctgtccgcaaacactctcttatagtggttgtagacagccactgacatgactttctttgcccgctcctgtccaatcacatattcgtccaggctggcttttattttgtgaggcgcgggaatacttctgatgtcaaatgcctttggcgctgtgttctcctgctttggctcctcttttttcttcttcacacgctgacgctttggaatctggttctgcagcgtgttcagatcgatcatgcttacatttggcatgttcttcattaaatcattgtagtcaataggcgcgttgttcattgtgtcaaagctcttctgcatgcattccacacagatatggatatcgttcggcagatcgatcatcttccccgccttactctccggtcttctgcacatgaaacatatcttctcataatcttcctcatcatttgaggcgttgtctgctgttgttttgtctttatcggatttctccaaatagtccttatcgtctgccatttcctgttatacctgccttttctatataaaatccacactaaaaagtttctgcatcgtttgtgggtatcttatcacaaaattgtatgagtaacaagtaaacttttcattaactgccttccccaactaaccaaaaggtgtctgcctgcacgctggcgcatacaggcagacacctctctctatacttttagaccttagcgtttcttttcatcttctgtggttgttgtcttggcatctttcttggcacccagagtcactgtgatggtctgctctttgtactccccgttctgagcacgtgagatgacaaaatccacgctctcccctgcttcatagtattgcagtctctcgatcagctcatccctggtatttaagcttgtgccgtcaattttcaggatgacatcacccttctggattcctgcctgtgctgcaggaccgtcttcttccaggctgtagacaaagacacctaccggcataccatatacctgaacagcctcagatgtcacatccgtacacgtaattcccagatatgacgccttactctcatcctccaccttatatctggtctctttgctcatcagatcatccagaatcggctctgctttggagatcggaattgcaaatcccacaccttccacctcattggacgcgatttttgcagagttgatgcctaccagttccccgttcatattcaaaagcgcaccgccgctgttgcctgggtttatcgctgcgtctgtctggataaaggtactgttggcattctcagagcttacctggcggttcagggcactcacataaccgctggtcacagactgtccgtaaccaagggcatttccgatagccactacctgatctcccattgccagggcatcggaatcaccgatagatgccactttgatctcctccagaatatcctgaggaatgtcagagagctttactgagatcactgcaaggtcattgtcggcatctgtgcctttcacctgagctgcaactgcgcttccaggattatcagaatcatcattggcatcattctgtccgctgctggtcttctctacctgggagcttgtaactgcgctgccgtcctggttggtaaaaaatacagtgagagaatccgcgccgctcaccacatgattgttggtagctataaggagttccgtgtcattctggctgacgatgattcccgaaccgctgctttttgcctcctgaggctgattgccgtagaaatatttgtagatgtcaggaagttcctgaacactcacacccacaatggatacaatagaaggcatggcattcttagccacctgtgcaacggttgcaccggatgtatcggaactgcctgtgctgatggcgtcatttccctttgatgcgttgtctcctgtggtctgggtgctctctatctttatattctcttttgggattgccttgccgcccacataattcgtagcctgaaaaaccacacctgccaccagaccgaagactgctgcgcaggctgccgctgtgcccagcttctttccgatcccgccctgtggtctttttggcttctcttttttattattttccggaggaactggggaagtaaatctgtaggaatcataatttttcttctgttccttctcataccattcttcttttttcggttcgctcttgtaagatttggcgtacaccgggttatccggcgtgggagctgcagcgggatcacctttgctctgcggtgcattgtcaggctgctgtgtgctgctgccggactgctgtgtactgccggtctgctgttcattggctgcagccgcttccgccattacgtccccattcccatagttgggtgaccctgttcctgctgccggaccaggtgctgcctgttccggtgataccggtgctgcctgttccggctgtgacggcctttcatctgctgtatctttcatggtaaagttcactccaccaggagtttccataccggaagcactctcctgcggtcccttatgttcttccgccataccgcggtcctcattcataccctctttaaattcttcactcataacacattctcccttcgctgctatctattactttagtaactattctgtaagggtactgaacagttacattgcctttttatctttctgaacatagtctaccaggcatttgtgttcaaattgtgataaaacagcaaagaaaagatgaaattctactctacagtcacagattttgccagatttctcggtttatccacatccaggccttttcccagtgatacgtaatatgcaaaaagctgaagaggcactactgccagagagttggtgaaatatttattggtctttggcaggtagatcacataatctgctgttttttcaatctctgtgttgcccacatttgtcacagccagcacaaacgcgcctcttgtcttgacttcctggatattgctgagggttttcttgtacagctcctcctgggtggcaaccgcggtcaccagggtatcctcctcgatcagggagattgtgccgtgctttaattcccctgccgcgtacgcctctgaatggatataggagatttcctttaatttcagggaaccttccagtgagatcgcataatccagacccctgccgataaaaaacacatgctctgtagccagataacggttggcaaatttctggatcctctttttgttctccagaagcatttcaatctgtcccggaagtttctttagatcctccaccatctctgccatctgcgcatcgtcgatctcacccctggcttttgcgaatttcagtgccagcaggtagtgggcgatcagttgtgtgctgtatgcttttgtggttgcaacggcaatctccggaccggcccaggtatacatcacattgtctgcttctctggcaatggagcttcccactacattgacaattcccaacaccttgatcccgtgttccttcgcctcccggagcgctgccagggaatccgcagtttctcctgactggctcacgatgatcgccagggtatccggctcatagatgggatggcggtagcggaactcactggccagatctacctccaccggaattctcgcaagcccctcaaatacatattttgcggacacgcaggtgtgataagcggaaccacaggcgatcatatagatctttcgtatactgcggatctcatcgtcggacatgcccagctcttcaatgaccacatttccgtccttaatgcggggattcagtgtatcacctactgcctggggctgttcatacatttctttgagcataaaaaactcataaccgcctttttcagccgcatctatatcccactcaatagtggttggctctttctccagctcctcttcatcgatattaaagaaggtaatgtcattctttgtcatgcagacaatctcttcattctcaataaagtacacatctcttgtgtatttcagcactgccggtacgtcagaagcgatcaggttgcccacactgcttctgcccacgatcaggggactgtcttttctcacagcgtaaagcttatccggctgatcactgaacatgattcccagcgcataggagccttccatgcggtgcatgatctttgcgatagtctccagcggatcccctttatagtaataatccaacaggtgggcgatgatctctgtatctgtctcagacacaaattcatagcctttggattccagcttctttttcagcttcatatagttctcaatgatcccattatgtactaccacaatggatctgtctttattaaaatgaggatgagcattgacatcagacggcgagccgtgggttgcccatctggtgtgcccgattcccactgttcccggaagagttgccccgccgtgggtgagttcatccagaatttttaatctgcccatggatttcatcatctcaatggatgttccattatagacagcgatccccgcggaatcatatcctctgtattccagtttctccaggccctccagcaaaataggcgctgcctgttcttctccgatataaccaactattccacacataatcatttcctccatgtagccggattcctcttcataagatttatcgtaactgttccgtacccttgcagtcactatttatcttattatccggtgtgtttatctttctatccatgaaacatggcttattttagcagattattgtgttgatgtccagtaagaagcgttcatggtacaaaattttattacgaattttggcaaacggcgataggattttcccattcggtatcccagaaatttaaatccgctcttcacaaccagctctgcgatgagccagggcttgtgtattttacacaggtatcctgctgtctgctttaccagacggatgccctcactctcagagcggatacctgcaaagatttccggatggtcagcctgggagaccgccagatcaaaattacgccggaactgctgcatacatccatagttgtgagaatggatcaccctggcatctgcccggtatgccacccggccgccattgaggatcagccgcccggcaaaaatcatatcctcattgaaaatagtatgcgtgataaaccctcccagttcctcgaatgtactccttttgtaagccgcgcatacattggagcagaaaaaagttttgattcccagctccggcagatcttctttgctcttgatgctgctctctgccggatagttgaaggaacgtgtatacttttcaatgatcctgcagtccttgtcagcaagctgtctgccgtaggctgcccctacccgcggatcttgaaaggccttcaccagttcttccaccacatgttcatctgccggcactgcatcctgtgtaaaaaataccagtatattacctgtactcatggccgccgccctggcccttgttcccccgtggtcgaattcctcttttttcaaatgctccacccggacattctcgattccctggatccaggcatatttccagtattctttttctgtattcatgatcaggatttcttttatgggataggtctgtctcttcagcccattcatcagcctcctgaacttttcatccggtttgtatacaggtatgatcactgtcactgtataagaatccataggatccctcctttatatggcacaggggatgccgtgttatacacacaacatcccctgccgcttttcttatttttattcgtaagattcttctccgctgcttccgttgtcaccggaatcatctgaaccgccgtcgctatatccgctgtctccgccgtcactgtaaccattgtcattattgctgccggagtcattggaatcatcataatcgtctccgctgttgtaatcagaggagccgtcatcgctgtagtcggaatcactgtaaccggaagacccgctgtcgctgtagtcggaatcactgtaaccggaagatccgctgtcgctgtagtcactatagtcgctgtaatcactgtcattattatcattggaactgacagaaccgctgccgcctgactgtttcagagctgacccgtcataagtagatgcccgttccgatatcaatcctttttgttcatctgaaacatacgaatttccaaatcctgaaaaacctgctatataatcgcttctcttctttaccgtttcagaaggttcatagctctcttcgccaaaaaggaaatgatgcagcgccttgacatttgtctccagagttgtaggtatcacataatcctggccaaccggacttctcttcacctcttctcccattatgttgcttgtggggaatccactggtctctcccagcttataggataaaatacccatgcccagctttactagatcgctcttgctgaagtccgtagcgatcataggaaatacctgatccataatatcattcagcgtggaaagactggcttttttggctttttccacaataagggaaatgatatatctctgacgctccgtacgcttcatatcccagccgctggtgtatcggatacggcagtatgaggttgcctgtacaccgttcagatgaaaggatcccaggatttctgattcctgtttgtcatcaccgggatactccggcatttcgataggctcataatccatgcctgtcacctctgaagtctcaacgcagtagtcattcatattcttgatctcgacataggtcatctccacatccaaaccgcccagacagtcgattgccgtagccaaagccttaaaattcacggccacataattggtgatattcaaatccaggttggtgtttatcatggacattgcctgtgtgggaccgccggtattatatgcggcattacatctggtatagacgtcattgccgatattcagatacgtatctctgtaaagtgaaaccagctttacttccttagtgtcattattgatgctggcaataatggtcgtatcactctgtcctgattttacattttcttctctattatccacaccaaacaaagcgatattggtaaatcccttcaacgttttacttccaattacatcctcattgacttcaaccttgcttgcttcctccgagttgttgtcaagatccagcttgttcatcttttcattgactttcgcgtatatgaagagtccgcccaccaagatcagcagtacaaacagttcaataccaaaaagcactcttctttttctgcgccttctgacgcttttgttcttttttgccatttcacttccccttatttactaataagcgtttttgtttacaaagcccttaaacaccgtgagaaacagtatctttatgtcaagtccgatggtccagttttcaatgtagtacagatcatactcaattcgtttacggatagaagtgtttcctctgtatccgttcacctgagcccatcctgtaagtcctgggcgtacctgatgtttgatcatatatctgggaatctcctcccggaacttctccacaaagaaggggcgttccggtctgggaccaaccaggctcatctctccgcacagtacattgaaaagctgaggcagttcgtcaatacttgttcttctcatgaatttgccgaaattggtgactctcgggtcatccttaacggtccaggcttttttctcctcttcaggcggctgtacatccatggagcggaatttgtacatcataaaattcctgttgtgcagacccaccctctcctgcttataaataagcggcccgggagatgtgatttttatcatgatcaccgagaaaagcataatcggtgaaaataatacaattgcggccagtgcacctccgaaatccataatgcgcttgatcagagcattaaaggtattggaaaggggcacatatcggatattgatgaccggcaggcccagaatatcctctgtgtaaggctttgtagggatgatacggttataatccggtataaacttcgtgtgcacacctgatttttcacagagcgcaacaatctgttccagacggtaatattcattcagcccgagagttatagcgatctcatccagatggttctgcggaaggatcaccattaagtttgctatcctccccagcactttgattcccttatactctgtaccggcttcaatatggtcatccagaatccctctcaccttgtatccccactggggattggcaagtatacggtctatatattcctctgctgcacggctgtagcccaccaaaagcacatgcttctgattatatcccttggagcgcatctgacgcagtcccaggcgtatgaggtttctggacactgtctccagaataatattgaccacgtaaaaaataaagatgacatggcgggaaaagtctatctgtttgaccagatataaggccccgacaaacaggaacatcccaatggtattggccttgatgatattggaaagctccagccttcttccctgcatacgcttaggcgtatacatattaaacgcataatttaatatcaaatatccgggcacaatgaacagcagcgccgacatgtagacccggaaaggtaatcttccttcattgtcgttcaggaaaggtacataaaacttaatgacccacgccagaaaataagagagtgcaatcacaaaagcatcgatcaccacctgcagacggttgaaatgcttttggttctcttttatcaaggtttatcaccttctcttcttaataattcgcagccctctacactttactgtatcagctagctacgataattctaactaataatactataaatcttacgaaaaggcaacaaaacattttctgaagactccttaagagggcaaaaaaagggcgttttgcagatttttttaccacaaaatgccctttttctatgtaacattattccatatttttgttaaatatttacaattttcccacgatttccctgcagatttcttctgcgctttttttgtccgtatccacaataaaatctgcggctgccatatatttttctctgcgcttttccataagcgaactgatgtactccacagtcttgttgccctcaatgacaggacgttcatggctgtcctttaccctctccaggatcacctccggtgaggctgacaaaagtgccactctgccgttctttttcatctccgcaacattgcgctcccgcatgggcacaccgcctccgcaggatatgactacattttttctgttctgcagctctatcagaagttctgtctccagatcacggaagtattcctccccccgtgactcaaatatctccggtatgctcatattctcccgctgggatataagctgatccatctccaccacttccaggccatacatatcactcagtgtgcgggcaatggtggatttccccgctcccataaatccgatcaggacaatattacagccaaaatctcgcttgtctctcatgctgttcccctgtttctctttctagaccctctgcgcatcagccagaaggcactgaaccgttactggactttattatagcagaaacaggaaaaatagcaattattttttcatcagaccgcaaacaggtcgttgaacgcctcactcatggtaggatgcgtatagatctgatcacgcagcacctgatacggagcgcccagatccatggccagttttatggtatttatcatctcataggactcctcacaaagaagcattgctcccaggatctgtcctgtctcttcctggatcactaccttcaacattccctgagggttcttcaaaacctgtgcttttggaatggctgccgcgggaagttttgcaattttcaccggaatgcctgcttttttgcctccgtctcactcattcccacacgggaataagacggggagataaatacgctgtagggaaccgcctttctctttgaaagggcatagctgccgccgttcatcaaagaccatataattctgaaatcatctaaggaagtataggtaaactgcaggcccccgtgtacatctcccatggcccagatattgtcagccgtggtcttcagttcatcgtccaccactaccgcgcctctcctgttcagctcaacccctgcccgctccgggcgcaggccctctgtgtttggttttcttcctgttgcgatcagcacggcatctgcctccaggatttcctcctgtcccttgaatgtcagttttatccgggcatgcccgtctgcccggacaatctcctggatctgtgctcccagtttgaatgtcacgccgcggttttccagtacaccctgaatggcctccgctacatctctgtcttctcttgggatcagcacttccccgtcctgcaggaccgttacttttgtcccaaaaccggaatacatagaagaaaattcaagtccgatataaccgccgcccacgatcaccaactgctttggatattctctcagatccatcagttccgcgctggtgtatacatagggattgccttccagacctttgatgggcggaatcacaggagttcctcctgtattgataaaaattttttctccttcaatttcaagagtttcctcagacgtctttatttccacaaccgtgttggagacaaaagacgcggttccattgtatacatccacattggccaggtcatccagttttttgaaattcttttctcttaacatggaagtgagccgtctcttttcatctatagccgcctcataatccgcagctctctcttccagagaagcgtctttcttattaaatgcaagtccggagcttctgaccaaagattttgacgggatacagcccacattgatacaggttccgccgtacatacccgcatctttctcgatcattgccacctttttcccctgtcctgccagcttacccgccagtgtcttgccgcccttgccgaaaccgataatcaccgcatcgtattttttcattttcctttccccttctttccttggaaaatctttctgtctatatcctctattgtgatctgactcaatttttctctgcacacttcattgagctgtccgtaaatgtcatccatgatatccgccattcccgaggccaccatgcagtccatatcaggattgccggacttccaggaagggcacactgcctctgtctccaatgcgtcatagatcatggcaaggttcacatctgccgcctccatggaagtgtgataccctccattttgtccctcttttgttgcaatgagatccttctttttcagttttgccataacctttctgatacgtgcaggattggtacagacattcttggccagctcctcactggccagagtctcctgcttatggttcagataaaccagcgcatgtactgcaattgcaaattcacttgtcatttttctcaccctcactcctgttcttttttatacttgtgcatatagcgccccgtttacagctcctgatacagtcgccgcagcggatacactctctgctgttgggattttcccatacacggatatccatcctgcaggctctctgacagcttccgcactgattgcacttggtctcatccacctgatatctgtacagggcaatgggattaaagagaccataaatcgctcccagaggacataaatacttacagaacggcctgtataccataatggaaagaagtaccaccactgccagtattgcagccttccaggcaaacagaaaaccgacggccccttgcaggtcattatttaaaagtaccaggggaattcctgctgtcaaggttccgctgggacagataaactgacagaaccagggacttccctgtccgatgatatccacatagaacataggcagcagtatgacaaacaccactaagatcacatatttcagccatactaacagcttatgccccggcaggttcttcctctttcggaaaaatgggatcttgtaaagcaaatcctgtataagcccgaaggggcacagccacccgcacacaaatcttccgatcagggaaccgataaagatcaaaaaaccaataatgtaaaaggaaaaccggtaattccggctccccagcactgcctgcagagaaccaatggggcaggccccaagcgctcccggacaggagtaacagttaagtcccggcacacacagtgccttggtcggccctttatatatttttcctttgataaatcctaaaacatagccatttgtcagagcagtgaatcccacctgcactatgagccgcagcctgtttttcatcttctgcaagatatcagccaattcctatacactccaaacatatattgattgcttttgtaagtaccgtatctgcctctccccggctcactccaaaaattatgaaagctgccgccgtaacgagaagcaaagttctgatcactgccgctcttctattactcattctgcaccttctcaagcatttcgtcaataactgctgtccactgcttcttactctttgcccccggataagtatcgcctacctgattgccgtccttatccagaaagatggttgtgggcactacctgcgcgtttttcaggatcctgtactgcatatttgcatccttgggaatcaccaggtgcgtgtagtccgcctctgttttctttacgatctcaagtgccgtgtcatcttccggctggctcacatcgctgatgatgcctaccatctgaaatcctttgtctgcatattcccggctcagttctccaagctccggcatttccctgatacatggcccgcagaaggttccccagatgttcaccatagtcagatctgcctttgcaaatatatcctggtccacctcctcaccgtccagagtttttgtcttaaactccccgaagatctcatttttctcagacgcttctgctgtattgtctgcctgggcatctgcctgcgctgtctctgcctggctgttgtccgttccagtgtcctgctttttctcttcttctgcctgcacgttttcttcagacgcatccttgcctgcgcttttggaagctgcactttcctctttctggctttctgcgctctcctcagtctgtgcctttgtcttagctgtatcatcctctttatttccacaacctgcaagtaccccggccgctaccactgctgtcactgccattgccgccaaatactgtctccgtcttctcatggtataacctccatattgttattttcattgttacagttcatactgaaattatattagttacagttgcaaatgtcaataggttttctccataaatttcatatttataaatcttatgtgaccagatcacataatttctgtttgatctgggtatttttcagagctttattagcataaaaaagacgcaggcttccattttgaaaaaagggatactttcacagaacatgataagagctgccgggtgaaaatctttcattttccacccggcagctctcacaatatcacattatttttccggagagataatgtacttcccattggcccttatctccggcctgctcaatacatcctccaattcattaagcccgcatacctcatacaccatgctgctcacatccagtcttccggaattgatcaggtctaaggcccttctctgtgtataaggattaatataagatgccttcagcaccagttccttctggaagatctgaaatggtttcactgcaatctgttcatccggctttgtcagtccaaacatcatcacaactgctttattccctgctatgtcaatggcctgctcaattgtggacggacgtcccacacattcgatcaccacattcacccagttcatcccgcattctgccagacggctttttacatcttctctcatggggtcaatgcagatatcagcacccagcttcttacccacttctcttttattttccaccggctccagaagtgccaccttagctgctccggccagctttgcaagctgaagcatcagaaggccgatcattccgcctccgataacgaccacctggtgtccgggctggatctcacacatgtcgatcccatggagacagcaggccacaggttctgccatggctccctgttcaaaggtggtattctctcccagaagatatacctgacgttcatctaccgaacaatattctgcaaaaccgccgtccacggtagttccgtatcctatcatattctcacagtagtgtgcaaccccattcctgcacgggtcacaggctccgcagtaacagttggggtcaatgcatacccggtctcccggcttgtaattctttacctgacttcccacttcactgatgatgccggcaaattcatgccccaaaatagtgggcggagtcacttccgcggcccccttatccccctcatagatatggacatccgttccgcacacaccacatgccttaacctggatcagtacatcatgggggcccacagcaggcacctcatgctcttccaccctcagatcatgttttccgtaaaataccgcacttctcatatccgaatcctcctgaactataaattatccaacttatgattatgtattacgcataagttcactatatagcaaaggacaaacgattacaattgacaataatgccaatattatatataaatttttattcattttgctatatcttttgattagtaattgtgtttttcttttctgcatactaaaatagaatcagcaagacagcgggaggaattttatgaagacaactggaatgaccacaatggaaataaaaaaaataaataaaagcaaagtatatcatctcatatatgacagcaggaccatctccaagcagggaattgcctctgccctggagatgggtatgaacactgtcacacagaatctgaagcttctggaagaagagggtatgatcgagcggaagggctgctttgagtctacaggaggcagaaaggcccgggcgatccgcatcctgccaacggcgcggatttctctcggcattgagatcctcaggaaaaggcttcatattgccgctgtggatctgtacggcaatattctggagcaggaatcctacaccatccctttccaggtttcctcttcctactgtgaacaggtgggccaaaaggtaaatgctttcacggaaaaatacgcgttttccccaagccggatcctgggggccgcaatcgcgatccagggtctgatctccactgacggctcttcggtcagctatggcagggtactggaccatacgggtatgaagctttctgattttgcccgccatattccctacccctgccgtctggagcacgactccaaggctgccggttatctggagacctggcatcaggaaaaattccgtgattccattgttgttctgctgaaccagaatctgggcggcgccgtcatattggacggaaaagtacataacggcctgggtatgcacagtggttccatcgaacatatgtgcatcaatcccgatggtcccctctgctattgcggagaacggggctgtctggaaacctactgttccgcagacagcctggagcgggctgccggtactgatattccctcctttttcgcggagctgcgtctcggtaatcctgcattttctaaaatctggaaggattatctgcgacacctggcatttgcagtctgcagcctgaatgtggtgctggactgctatgtcatcataagcggatatctggccccctttttttctcccggaggatctggaactgctgacacaaatgatcacagacatctcacccttcaaacagcagaaggattttatctttttgagcagtcacggacagcttgccccacctgtgggcgccgccctatactatattgatgaatttctgcacaacatgtaaagaggaacgggagccgtccggttgactgctcccgttcctctattcaactgtttcctctattcctcataaaaacagacctggtttttcccgcgtttttttgcttcatagagcgccttatccgatttctgataaagctcagaaaaggctgtcccgtcccggggaaccagcgccacgcctatactgacggacaatctgcatccgccaaacccttccggcaggctgctttggaaattcaccatgagctgcccggtcttcctggaaattttctggcgctcattgacattttttatatataccacaaactcatcaccgcccatacgccctataaaatcatcctggcggaacgtatttttcatacaggccgcaaagagctgaagcaccctgtccccctggggatgtcccagcgtatcgttcacattcttaaaattatccagatccatgatcaggaacgctcctgtattaccgctctcctcgatcattttatctatctcctgttccaatgccctcttattttttaaaccggtcagagaatccctgcctgcgcttttgacagcttctttgagctgctgcttctgatggctgatatctataaaggcacactgtaccaccaggctgccctcctgtctctgcacatcaaaattcccatatgcccatttgttctgctcattcctgcatcgtatgagaaattctctggagaccagcccctccctgagattcaaaaaccactcccggtcctcctcatccaaaaccggctgaagggacgtcccatactttttccggtactcctcagcagaatattccataaactgataaaacccattgtttgaatccaggatcggcaggtccccttccaggcgaaaacgcactatggcactgggcacagtccggtatatagagcggatgttttcatatgcctgttttatttttttatgggttttgcgacggctgttcagcattccaaatgccatcagccccagcaccagaagaactgcgacgcagtaaactgcagtgccgtcaatgatgtcttttgtcttggcatccaccacattacaggggatcaccaggagcagataccagtcattgatccccacagccgtatattccaatatatactctttgccgcttttctggtaacggatatacccattttccttttctttcatgtgatccgcaaattcccggagatcctgtctgctgaacgctctgccgatcacattttccagatcctccagtatattttcttttgcgttcccctgctctgagcgcactaaaacttctcctgtggaatctgtgatatagttatatccctctccgttaaaatattgaatggacatgagatcttccagctcgtccatggtatactgtcccagcacaatacctttcacctcattgtcacgatatatgggtacactgatcaccatcattctgccgctgttggtgccgatcaggctctccaccgaactctctccctgaacggccttttggaaatatcccctgtcctttacattcctctgctgttccatgccgttaaaatacatattcccgtccagatccaccacagcaagcctggtaaaacgtgtaatctttgacttttgttccagaatatctaaaactctctgggaattgacaggcgttgtctgtcctccgatagaatcggctatcccttccagatacagatagtcattattcaccctctcattgatcagcttgatactctgctgcgcaagctcctgggcataggcattcgtttcattttccagaatgtcatgaatataagcagcatagtaaaaggatgctcctattatgaaaccaattgcaaagatgagaagaactgctgtcatccacctcttttttctctgcatagtattccttcttcccgatttccggctctctgccttttttatctattatataggagcagggatgccgcgtcaatttgataatgaagaaactcctttacagtttcccggcaagtcgattataatgaaaatatagcgaaaaagaggaggtacattatggaaaaagcaaaaaccgttttgaaaggcattggtatccttttactgatacttgcaggaatcttactgcttcttttggttttcctgacaatacgggaataccggccaaaggcggaggagactctgacaggcagttacaaagacggggaactcctctcccttagccgtccattctctgtcatgagctacaacaccggctatgcatcgctgagtaaggacgaggattttttcatggacggcggaagcaaagtcaaaccggattccaaagctctggtagaagacaatctgtccggtatcacaaacgtcctaaaggacaatccctccgacgtgtactttctacaggaggttgacattaattccacccgctcttacggcattgaccagcgcagtgcctacagcgaagcgctgaataagaacagcttctttgcgtataatttcaagtgcgatttcgtaccttatccgcttcctcccattggccatgtggaaagcggcctggtaactttaacggataactatgtgacagatgcttccagaatttcactgcccgaatctttctcctggcctgttaagacctgtaacctgaagcgctgtcttctggtcacaaggttcccgctaaaggattcctccaacgaattagtgcttatcaatttccatctggaggcttacgacagcggagaggggaaaatagcccagagcaaaatgcttgcggatatactttcccaagaatatgaaaaaggaaactatgtcattgcgggaggagattttaaccagactttccagggcgttgacaaataccctgtcaccaacaaggaggactggaccccgggtatcatcggagacagtgacctgcccgatcacttttcctttgccattgacgattcctatcccacctgccgtctgctgaatgccccttacacaggatcttatgacacctctcaggtatatgtcattgacggtttcatcgtgtctgacaacctggcagtcagaagtgtaaatgtcattgatgtgggatttgaacatacagaccaccagcccgtacgcctggaggttgcatttaagtaagtatactgatttgaaggattcccgcatagagtatctacagaagatattctgtgaaaaggagtctttacatgaaagagatcagccatatcaaattacaaaacaagggagacttcatagtgcgccccggctttgtctatgtggactgccggggccgccggatctatgagaagggacgcaccatgctcgccaccggtgcttccgccaccataagccttaaggaccacggaataccggaaggctcctgcataaccttttatgcggaaattccgcaggggcctgaccgggaggcccatcagatatttgtatactcggaatcctgccggaatacagccagctatgtcatcagcggcacagcggctgacagtaccttgggttttatctctgatacactctgagccttctgtacacagaatggacagcatccggaatcaggtatcgtctgatacctgattttttgctgcagaagatacccccaggccttcacacacaggcgcgggattcctgcgggcaggatttctgcctgtccggtagcattccccgaaaaataatgttatattattaactgaagaacatgcatgatatatagagaaaataattacggaggaaaatattgtgggaagtgaaatggaattacagcaggtgatctaccatatttttgtgacacagatagaattcggcacctatcgcttaggtgaccgtctgccgacaatagaggaggcgggccaactgctgttcgtttccccggacactgtccgttccgcctatttacgtctgaaaaaggaagggtatatcacactttccaaacacatcggagctgccgttgccgttcaatttaacgaacaggagatcagcagtcacatactgtcttattttgcattgagaaaaaatgccatgcttgatctgagtctctccatgaagccgctttttgcccatatccaatgtgtctgtctaaaaaatgccggaccaaaattattggatcagatcgagtccatcacatcgcagcaggactgccttgcctcttactccttgatacagtatatgttgcacatctacggttccctgaaaaatgatctcctcatgcgcctggtctggcaggtattcatgttttttcaggctccttttctcagcgttccacaaaatataaagcactttaagtggaaggacagccctctgctgcacacgctccaactatgccgggaacaaaattggccttcgctccggacttccgtggaagcctttcaggaccgcctggcgtctgtattatatgatttctatgaaaataatatagactccggggaacccgtaacccaaacagccttccattggaacagttataaaaaagcctcccagctctgttatacccttggcatggaaatattgacggatatcaacaggggccgatatactcccggaagctttttgccctccctggaaaaaatggcaaaagaaaagcaggtctcagtcagcaccatacggcgcaccctttccctgctcaacagtatcggggtcacaaagtccgtaaacgggcacggcaccaaaatactgcataagaatgaaatttcagaaaactgcgacctgactcagcctgctgtcaggagacgcctttcggattatgcacagagcctccagctcctctttttatcatgcagggaagtttcaaaaatcactgtggaatccctggatcaggagacaatgcttcagtttataaagcggctgactttgctgcggcgccttcagagatatgaactggctgtctacggcattctggaactgatcacacactttgcaccgctgcaggccatccgaatcgtatacggtgaattgttccggcagcttttgtggggatatccactgcggagcataaaggaagacagcgaagaatcaaaaaaaatctgccttgcctcccttgatcattttctggaatgtctcagccgttccgattgggaggaattttcctccaaactggaagaactgctccaatctgaactggcctttaccgcagaacagctcaccgccatgggaatcaggtcattccatccatttatttaacacatcaagcagtctttttatttcaatgggctttgcgatatggtcattcattcccttgctgcgggcttttgccacatccgcggtaaatgcatctgctgtcaatgctatgatcggcactgttccggcatcgcaccggttcagtgaccgaatggcagtggttgcgtcgtagccgttcatgaccggcatctgtatgtccatcaggaccgcattatattcacctatggcggaagcttcaaacgcttccacggcacgctgtccgttttccactgcgtctacaaggatattctgcatctgaagcagttccactgcgatctcacggttcatatcattgtcctctgccagcaggatctttttacagtccatccgggtatgtatattctcctcctgcacatttctttcatcaccactgtcagatgagaggaatacatggaggacctgcagcatttttgatttaaagagaggctttgtgataaacgcatctgcccctgcctgcaaaaattcatcctctatttcagagtaatcataagctgagacgattatgatcggcacatccgtgcccagttcttcacggatggctatcacagtctccagtccgtccatctccggcatcttccagtccagtataacagcaaaatagtcgtccttctcttcatgggcctttacaataagatggacggcttcccttccggacatgacccagtgtccgcgcattcccagttcatcaagcagtgccgctgcgctttcacatgtgatcctgtcatcatcaacaaccaacaccggcagcccggccagttcatcgccatattcctctttttccagacagagttccagggggacagaaactgtaaatctgctgcctttgcccggctcactctgtacatcaatggaaccgttcatcattctgacaatattctccgtaatggtcatgcccagacctgttccctgtagtttgctgatacgggggtcttctgccctggtaaaaggttcaaatatgcggggtataaattcctctggtatccctatgccgctgtcgatacagataaattcatactggcttttgccgggagacggtgaatacagttcattgatccgcagtataattcgtccctgttcaggggtatatttgatggcatttgataaaagattcatcaatatctgctgcagacggtcaccgtcagcaactacattctcatgccgtacctgaccgatactgatctggaattccagctttttttctatgaccagaggacggcatatatctgttatgttctggatcatatccggaagattgactttttccggattcagatctatttttccgctttcaatctttgacatgtcgaggacttcgttgatcagactgagcagatggcggctggaagtgccgatcttgttcagacaatcgcgtatcttttccggtgaatcaatattagactgggcaattgccgccattcccataatggcattcatgggtgtccggatatcatgtgacatggacgagagaaaattggtcttagccatacttgctacatgggctgcctgataggcttcttctagggcaacgcgctgcctctgctgctcctcccgctcactggtcatgtcaatccctacactgtaaaaggatggaataccatcccaactgtcctcaccgtttacaaaactaaaggtcacggtcaggatcttggtcctgccgctgcgggtgatgatacgggcctcaatactggtatccttcccgttttttctggaatcctccataaccctgagcgtgcgttcctgatcgtccgggtgtatatagtcacatctggaatgcagttcagattcaaactgctcctttgtatactcaatgatctccaaaaaccctccgccataccagagaaccttcttcatgtcctctgcgtccatgcgggcaaatccgccgggaatggtcctgacgatggcttccttttcccggtccttttttgccaggttatattccatgctgtagttatcatgagaaagctccaggcgtgccctgcgcccttcccaattgacaatacggtctttgatcaggaatgtgcgttccagtacaggattataaaattcccactcataaaattcatcttccgtcaaaaggtggtttgtacaaaagggacaagggctggtccttccctgtatcacctcataacatttctttcctgccgcctgctcaaactttcggcccagtgtttcacaggaagatggattcaggtagagaagctcataggtctccatatcggagagataggcatttccctcgtattcatccaacatccatttaaaataatcagccttttcctccagatcgtgacagctcccattcccggagcctggcagcctgctgccctcaccggatggctccctgcctttatcagttactgtacggtccgtatttcttccacattccatgcctttctccttcagcaatataatccatttatatctgtaacaacagctctgactcaaaattcctgcttgttcacatacctattttgtattatatcataaatgaaggaaatagcaacggttaagaaaccggcaagatgtgttacggcatttcccagagcctcctgccctcctgcggtgagaaacgttcccatttttgaagatgccacgattccgctcgccatggggaaggtcattccggcaaatcccgggacctggattacagtctatggcacagtaattgcatgtggattgtgttcttctatctaaaaggataacgccatatacgcaaaaaaaccgtgacaaaaatccacggttttcaaacaattactcttctttaaaatatcggttcagtacatccgtatccggtatcacaaaggtgttcctgtcataacggacaagcccctgctctaccaggactttaagctggcgggacgcggtctccctttttgtgcccagcatatccgcaagctgggttaccgttagcttcaggcagatgcggacaccgacctcctcctttttcccataatcacgggccaatttccacagcttggctgccattttcttttcccctcttgtggcattggtggtattcttaagctgccggtacagcctgcgcactttatgggactgggaggaaaagagaaaacgcatgagtcttgcatctgtctccatcaacgccagaagctgctttctgggaatggccaggatccgggcagattccatgatctcacagctcacaggctccggcagatcctgaagcacttcctcattcagcagactccctttgcccagaacaaagatcactttcttttctcccatggaattcatcttatataacgcagccgtcccgctgaccacagcatatactgtgacgatttcttccctctcccgatacagatgctgcccttttttcatttccagcagcacactgtagcgggccagatgttcccggctggactgccgtatcccatccgcaccgaatatgatcctaagtgattcctctgtctccttcactctcgcgctcccatctcactgctttcactcatctgtctgtgaattgtttttataactgccttttgcggtccaataaacacataggcttacttctgacttattatatcgtaacagatgacaaatatctacaataaatttcaggatacacgcagggatatcagctctgtatatgtggtatagaagtatccgatccctacaaacagcaacagcaaaacccccagaaacaacataaaatgatactgatgttcacttcgcataacactcattttataattcatgcaccaggttttcacagattccatgctgcccaatatgagaagcgcagcctgtacggcaggaaacacaaagatttccgtctcctgcctcaggacaaaatacgcaggaatagcagcaatcaccgtcacagcaaaaacgatccatgcctttttattattctgaaatatcatatcacattctacctccacagccttttttcgcatcttatgactgttttggcagaatgtcaatagactcctcacaatgtcccttttttcctgcatgaaatattgctttgcgattggccggataccgggactcagtccgcgttaaggaaacatcttctcctctccagctcttcatccatgtttccccgctctttatccagtctgtaaaagcacatgactacgccgatgatcacgcagagccccatgggaatccagataaaactggcttcaatatacgcaagtgcctttggtgtctgcgctgcatttgccacatatccgccttgtttcagaagaagaccgatcactgcgctggcaaggcccatgctcgcttttacaaaaaagccctggaaagcggcgataaggcctgaaacgcttttattttttctgtattcagaatagtcgatcacatcaggctgaatggcaaaagtggttccgaatatgccgtagataccaagccctgtcactgccaggccgatgatcagacatactgcggaagtcttaccaaggtatatgatcaaatctcccgctatataaatgatcacactcaaaaacataacatttcgctttgacatcttcttctccagatatggaagcacaagaagcatgggaaggcccgaaaggattccaaacaatcccacaaaggtcagccattccgtcttctgaagattatatgtaaaataataaataactgtagtattgcgtaccacatagatggcaaaatagaggaaatttaccgcaaagaaaatcacgctctgtcctgtcagcccttttaaatcctgagcaagagaagatttctcccgcttgacagagggcggcaccacttcctccgtatttaaaaatgtaactacaaaaataagcatggctgcgattccgtagatggtcatagtcaccagataacccttttgggcatttcctcttccaaaaaactccacaaggggtgaggtgatggtcataacgattgctgttccgatcatggcgcagatcatacgggaggaaaccagacagtttctctcatgtaaatctgaagtaagccgcggaacaatggtgttaagcggaatgttcaccactgtataagctgtacagagcagacaataggtcacataagcccagacaatctttcccgtcatatgtaaatccggcacaaaaaatgtcatgatagtaaagacagcaaacggaactgctcccacgagaaaataaggtcttccctgtccccattttgtgtgggtcctgtccaccaaaatccccattcccgtatcagtcagcgcgtcaataaactttgtgaccagcatcagcgtacccgctacggccgctgatattccaaacacatctgtataaaatatcatcagataagacgccatggtactgaataccagattgcagccgagatcccccaccccgtatccaatcctttttttccactttgatgtcacagcaccattcccctctgacgggatgttctgcaaaccctctgcctgctccatattccttcctccttaaatctttttcttccttctttttatcttttttacatcttattttccatgacagtccctattctgccagttttgtaagctgcttcatatcttccttcaaattttgatagatagagtgatacaacctaaaatattcattgtatttttcatggttcttctcatccggcatgattttttcgtccagcacctgccattttttcactttttcataggacagaatgcctgtaccgatacctgccaggatcacatctcccatattcgcttccacatcctgttttggacagaccactggatagccggtcacatcagcgaaaatctgtctccacagttttgattttgtcacccctccggccaggaggatatactcaccaagctcctctcctgtggcttccatggcgtctctcagggaataggcaaccgcctccagaaatgcccggtacagatgacccttggtgtgcgccagggacagccccactacagtaccttttgcgtcggaatcccagaccggacttctctcccccataaaataaggaagaacaaccagtccgtcacttcccaccggtatcttttccgcctgatggttcagaaggtcataggcactgcctctcccctctgactccgcgcgcatctcttcctctgcaaaggtattcctaaaccattttactatagcacctgctgttgctcccccggcaaagtaataggaaagatttttcgcatcatacaggtagggccatacgatcagcccgtttccttttaccggcttatcagaaatcagcgccgcgcacatggaggttccgatggccgctgcgtagatgccggattccagtacacccaatccgatattggcagcgccgcagtcaatgccccctgcaatgaccggcattccctccataagccccagactctgtgctgcctcttttgtcaggcctcctgcaatgtctgtggattccacaagcttcctgggcatcttctccatgggaattcccatagcctccatcatttcctctgaccaggttcttgtgcgcatgtcgaagatcccgccaatatttccggctgaagaatagtcaatgacaatctgtcctgtcagatgatatatcacataatcgttgggaggaagaaagagttctgtcttttcccagttttccggctcatgattctttatccagagcatttttgtgtatccatagtagggatcagcgccattctgggtgatatccagaagtctttcttcccccacatgtgacagaacccagtcactttcctcctgtgcccttctgtccatccagatcaaacatgggcggaccggctgcatctccttatcaagaggtataccagaacctccgtagagaccgctgacagcaagaccgctgatgtcctcttttgccacaccggatttattcactgtttccctgatagatacaagtgctgcgtccagccacacctggggccactgttctgcccataaggggcggggtgtcagcacatcgtactccaccagatgttttgctatgagattcccctctgtatccattaatatagtttttgtaccggatgtaccgatatccgtacctaataaatatttcattactgttctccttcagcagacatttttagctggctgtaactgctcagtacccgcaggtctgccgagcagctgcagccgttggctcttttttagaaacaggtgaaagctccgtccacaatgaaatctgaaccagtggtaaagctgctggtatctcctgccagatataccgcaatagactgcagttcttccggacgtcccatacgtcccataggcgccatggcattccactgttcgatcaaaggcttcaggcttggagagttcagtgtcagctctgttcccatgtatcccgggctgatgcagtttaccctgacaccgcgctttgcaaattcaatggccatggattttgtaagctggacaacacctgccttggatgcgttgtaggaacactggggctggggtacatttacaatgtgggctgacatggaggctgtgttgattatggagccgtgtccctgtttcagcatctgttttgccgccgcctgtgcagttaagaagacaccgcttaaattgatatcaataacttttttccactgctcataggtcatctcctcacaggggatgttcatgcagatacccgcattgcaaaaggctgcatccagtctgccaaatgtactcatgatctcttccatcatggcgttgacttcctccggctttgtaacatcggtccttatggcgatggtcttcacaccgttttcttttgcgataccggccgcagtcttttctgcctcctcaatatccacatccacaattgccacatcgctgcccgcttcagcaagggcgatggctatctgctttccaatacctctggcacctcctgttacaaaagatacttttccgtccagtctcattttctcgataatacccatagtttttctccttttctctgtactgcttgtttttgtgatttaattttgtaaaatcattttgtaaaatatatttatataataatcctcccagttcatttcgtcaatatgtataaccatccaaatataaggggtgatttttatgaatttctaccaaaggtgttctctgaaaatttgtgctatactctattgtataaagtttttttataaatctcctttacaaatacggaaacgcccttattccataccggcgtatacgatgatatacagaaaggaaagaataccattatgggaaatattacattgactgatataaagaaaaacaattattctctgatctataatctgttgtatgaacaggaaaagctctccaaacaggagattgccaaccaactccatctcagtctgcccacagtaacgcagaatctggtggcgctggaagaagcagggctgctcaaaaagggaggacagtttgaatcgcaggtgggaagaagagcggttgcctacaccatatgtcttcaggcgggaatcgggatcggtgtggagattttaaagaaacagataaagatcctggcggtggatttaaaaggcaggatctgtggctgtacagaacaaaagcttctctatagaaatgatgacgcttattataaggagattgcaggatttgtcagcacttttatccgggaaagcggctttatgaaaaagcaggttctcggcattggttttgctgtacagggattgacaacggctgacggacaggagatcatcttcggaaaaaccctgggatataccggtcttaagatcacagccctctccagatatctggaatacccctgcatgttcctccacgacgccaaatgcgctgccgccacagagctgtggaaccgcagagatctgacagatgccatatatctctctataggcaaacatctgggcggcgctgtgatcatcggcggccagactgtgatgggaaaacaaaaccatggcggtgctgtggagcatatgactttggtccccaaaggacggcagtgctactgcggcaagtccggctgcatggagacctactgctctgtcaacgcactgcttttggaggaagagacactggaggaattcttcaccggactgagggatggggataaggagaaaaagggaaggtttgatgaatacctggatcacctctccacagcagtcaataacctgcacatggtgatggactgtgatgtgatccttggaggacatatggctccatatctgacagaagaagatctgcaggtgctgcacgaaaaggtacgggagaaatccgcttttccggatgagcaggactttatctttttgtctgaatcggcaaaggattctgtgcctgtgggtgcggcgcttggatttgtgaaagagtttctggaagagatctagagtgcgtttttcaggaatctcacctttctctctgtcaccacatccccgggcaaaatctcactgcagaggatgggtgaatcagccgtataccgactccttcccgcagccgctgccgctctgctccggttggcatagcagtagaggcatccgtgaggacaggtatcgtaggagcctatgtctatgctctccatacagccgcactcattcctctggtttttatccttttttatatccaggccgcacccgcacaggtgccggatcagttccccgtcaatacagctcccgtgaccgatcccgtattgctgcaggtccgctttctccgcgcaggtcacgatctgcataccatgattttgggcagtatgagccagcttttcggcaaattcacccaggcttttttcctcaaaagcttcacagcccagcttttccaggttcttttttatctttggataatagtccagaaaactgatgacaacctgctttgtgtacccctccagttcttccgcaatctgggcaaaggcctgcagatggtattgcggggtataacgggcattgaagaaaaccgggtcatagcgccatacggcccgctctgctcctatggtccctgaaagcgatttgaatgcgggaagcagaatctttttcttatccggcagccctggctccacgtcctttccatatccggtcagggtaaactgaaaataatacatataccgctccagaagcggcagcctgtcaagcattggcacagggttcttggtccagaacacaatgcagtccaccacctccggcgccagggatatcctgctcacctgatgccggttaaagggattgcggacacaggcgtatccctcctctattctgccaaaaaaccaatccgcataatatgccggcacatccgtccttcggctcacactcaatatcaatcagaccacctcttcctcgaaaatatgttcgttttttctgattatacacctttctgtctccagacacaaccgtgacacaaatttcaagaaaaatcccccaaaattcgtcttgttccatccctctccattgtctatacttaaaggcaggaaaatgtaatgaaccgttacaggaaacattttatgacaggaggaacgatcatgaacagagaataccatgtggcagtcacaggctgcgatcatgcagagggaacaaaagagaatccctttaagaccatatcaagggcggcaaaggcggctgagacaggagacaaggtcattgtacacgagggtgaataccgggaatgggtgaaaccagagcacagcggctacagcaatatcagccggatcgtatacgaggctgcagaaggcgaaaaggttgtgatcaaaggctccgagcgcatccaaaactgggagaatatcgaaggaactgtctggaaagcagtggttcccaacacacttttcggggattataacccctataaggaagccctttggggtgattggttcatctatcccgatgacaactccgtccatgcaggcgatgtctatttaaacggcaaatcattttatgaagccaaatcccttgacgacgtgaaaaatccccagatccgcacagaggggtacaacccgccgtggacaaaacatccggaaccgatcaaagataaagagtggaccatccatcagtggtatgctgagacagaccatgataatacatatatttatgccaatttccagggcgctgaccctaacaaagaactggctgagatcaatgtgcgcaaatgctgcttctacccagagaagacaggtatgaattatatcaccgtgcggggctttgagatggcacaggccgcctgcccatggacacctccaaccgctgaccagccgggtcttataggcgccaactggagcaagggctggatcattgaaaacaatatcatccacgacgcaaaatgcagcggtatcagcatcggcaaagaagcctccacaggccacaacctctgcaccagaagacacagaaaaccaggttaccagtaccagatggaagctgtgttccgtgccctgaagattggctggagcaaagaaaagatcggctcccatattatcaggaataatgtcatttatgactgcggacagaacggtattgtaggccatatgggatgtgtattcagccagatctacaataaccatatttacaacattgccgtaaaacatgagtatttcggttacgagatcgcaggcatcaaactgcacgcagccattgacgtacagattcataacaataatatccatgactgtacccttggtacctggcttgactggcaggcacagggcacccgtgtcagcaaaaacctctactacaacaatgaccgtgacctgatggttgaagtgacacatggtccttacatggtggacaacaacatttttgcctccgcctacaattttgacaatatcgcccagggcggcgcttatgtccacaacctttgctgcggaaccatgagaagagaggatgtcctgaaccgttcaacaccctaccacttccctcacagcaccgaagttgccggcaccacacctgtttacggcggagatgaccgtctgtacaacaacattttcgtaggcagcgcagatgcctataccgagcagtccttatgcggaacggtaggctacaacggttccaccactaccctggaggaatatatggagacagttgcctccatgggcaatgaggatctggaaatgtttgaacaggtaaaacagcctgcatacattgatcacaacgcttatctgaaaaacgctcctgcctttgatgcagaaaaggaaaattatataagtacgtctgatccacaggtaaaaatcttggtggaggaagatggaacttatcttgaaatccatgcagaaaaagggctgcttgacacccctgctgaaatcatctgtaccgaaaagctgggaatggtccggattcccgaagctccatttgacggccccgacggtgaatccattgttctggacactgactatagcggttccaaacgctgcgaagcaccatctgtcggtcctctggaaggcctgaaagaaggatataacaagataaaagtctggggataatctcctcatggaaaatgggacgccctgtaacaaggcgtcccatcttttaaccacttttatctgttatctgctttcatttggatctttcatttgtccagatatcgtttttcatattcattcacagagataggcttgctgaacaggaatccctgtgccagctccacaccgcaggcgcggagaacggcaagctgctcctccgtctcaattccctctgccacgatctgtatccccatcttccttcccagctccacaatagagcctacgatagcccgggccttggtattgttcaccacatcatccaccatacttttgtccagcttcagaacatcgaattccactgctgacagaagtgccagattggcatactctgtgccgaagtcatcaatcgttacaatgaaacccgcctccctgagattttcgatcagaactccgatatctatgttatcaatgcttctcaccgtctctgtgatttcgatttcaagatatctgggggatatttcatatttttcacagattgagagaagccgctctataaagtgcggttggatcagggaataccgggagaaattcacggatacaggaaatccttttttcccctccctgctccattcctttatcttggaacagatgaattcaaatacaaagaaatcaatctggctgacagtctgggactcctcaagcagaggcaggaaattgccgggaagcaccagggaaccgtctcttgactgataccggatcaaagcctccgcccccactgccatcctgtccgccgaagaaatctttggctgcagatagactacaaactggtttctgctgatctcctctctgaggatttcagggtccgtcagataaagcagttcatcgctgtgatgacggtacctttttgaagccggattatttctgtagaattcctttttgtcctcatacattctggcgtctgcattggccactgcctgtcccacatccataagcttttctgtccattgggacccaattgcggccttacaaagctcatctcttttaaaagcagctctcagctcactcaccattccccggaactgttccttagagaccgaagggcagacgatcacaaactcatcgcctcccacccgataaaagtttccttccccaaaaacctgcttcatgcgctctgcgcactctatgagcactttgtccccaaacgcatggccatactggtcattgatgtccttaagcccgttgacatccaaatagacgataccaacacttcccacttttccggtcatctcctgcatatcttcaatgtaacggtttctgttgtaaaaggatgtcagggtatcgtgatagctgagatgggaaagctgctgctcatcctcggctctccgataggccagcagaatgaagtagcaaagagtctggagaatggaaccaatgttcatcagacgttcctccggaaggttatccactcccagacatcccatcagaaccccttctctctcaagtagtgccacagccgtattgcggatgttccgttcttcgatgatcgcttcacttcccggaaatacttctttaaactcttttgtatcctttataacgatacagcctttctggttcagcacctcccgccactgttccagccgctcatggggcagccccctaaggactttttctccgttttccacacccgaagcacaccactcataatctctatacaaaaagccttcacgcatattgaacatatatgctctctcagcttttaaaaaggttccgatctcctggagtacatcactcaccgcatctttcatatcctttttgcagtacagggttctgacacactccatcaccatctgttctgaactcagggcgtatttcagcttttctttttcatgttccgcttccgtagtgtcaaaagccagctccagacgtgcccgccttccgtcccattcgatcagacggtcttttaacagataatgacggcctgtgatcggattggtagtctcccaggtataattctctccgctctttaaaaatttattggtacagaaggggcaggggctgtcccttccctgaagtacgcggtagcacactttttctttaatatcatccacatgaaaactgcgctttcccgcatcatttataaataacagctcataggtatccatatcagagacatataaaagttccgatatttcgttcatgggagcctgcagatccttggtcattctggaaagctttcggcttttttccaaattggcattttccatcatatcaacagccctgcgccgcttttcctgctttttcatatagaatgccagcagaaccgccgcaacagtacatatgaaaatcagggcggcaaagcagatctgtgccatacggacatagcgttccgcatattcctccgcaacgccgacactctcatcagccagccagaaaaagtcttcgctgagactgtaaagccggccgctgtccgcgccgtctctcactttcaggatctcctgttttatttcactccagcgctcctgcatgctggtcatcatttcctggtattctgagtccttcagcctgaccagatggttctcccctttaccggtgcgcagctcttcaataatgccgtccagtctgctgatcaaagcgtcgtccctgtgaccttccagttcctccttcaccagcctctgggttgctccgcgcacaacaccggtataattgatgactcttgcatttccctgaagatttcccatagaatacaaggacagcagacctgataaaataagagcgaccaacagaaaaatagtcatcattctcttttgcatatgcccttcccctcaaccctttctcacagacagccctgcagcttttaagctgttcagtaccccccgcagttaccatatttctctttattattcttaagtataggatgtattttactgcaagtcaatctgctttgtctttatacattaaaaacctttttctatactttaatttggcgtagtccagtattcttttgagatagacggaatcgtaagctcccccgatcacgcctgccacgggaatcccctgaaggaacttcatatacagcagttcccctgaaagaacagcggaggtttcttttatctgttctctgctgtcatatccatggggcagggtctgttccatgataaacctgtctgcccggtcattgattgcttccagctcctctccgtaagacagggctgcctgaatgagcagcagtatgaaatatttctcctcctccgtgtcataaggaaatccatagtgcagtgccgtctcatagatacttttcagtatcatgcccgtaaaaagaggaatatccggaagaccgatacccagtatcccaaggcctactccttccactcctgccaggagaagatttttatttcccgcagcctccgccttctttttaaaggcgcggagtgtttttttattttccagcagtccggctgcgtaggcatctactttatacgtgtgctctatcttctccctggaatatgtcttctctatcacatccgttcccttctcaaatatgaggccgaatgccttttcaaacgccttatccagagtctcctgcagcctggccggtaccttttcttctaaagtccggtcaagaaaagaccctttcttctcctcatttcgttttagaaatgcctgctctttttttagaaccgcttctatctccgctgtcatagtagttttttttcttctaccgatcatgtttccgcctttccaaagaagtttctgtctgctgctactatatatattccagttcactgaatgcttttataaattctttttttccatatccctcgaattctgcttccagcatggtttcatcctcactcaccacaacgcctgttccatatctggaatgccggacaagcttctgctgtttggccggttctgtctgttccaatctctcttccggcctctcttccgttctctgttccggtctctcttccgatttctgatgcattctctgttccgaatacccggcagacatgctgcgcctctgttcctgcacctggcgttttaagtcctgcaggctcacagcagggcctgtatcctcgcagctttccaaaagctttggcggaatcatgcggatataacggctctcccccggttcagccctctcctgaggattggtgtaataggacagctccagatgatcctttgctctggtgatccccacaaaaaacagtcttctctcttcctcctccccctccatatccctggttctgagcggaatcaacccataattcacccctgtgataaacacacatgaaaactccagcccctttgatgcatggatggtcatgagttttacgctgtctttctcccggctgatatcctcccgcagcacatccagtccgtagagcgaggaggaattgacaaactcccgcattcctgacacccggtctgtctgctgttctctcacataggcatacatgattccaaacattctgtgcactgcgtcactgtcctcgcaaaatgataccgacacagggtttaaataccggtccagttcaaaataggaaaacagctcctcctcattgtccagttccctgcatttttccatcagtccgcacattttatcaaacaagacagattttccccgctgaccgtcccggacgatctcctcagcttttttcccgctgatgccttccccgtactcccggctggacagcacatagatcccggatgccgcgtcctttgtattcagagaaaagcgaagaagacggatgcaccatttgagcacaggcacatcacccaccgtcttctttaaggatacctcgaaggggataccctctcttaagaacacatcctcaaatattttggactggctctgcagacggtaaaacacagccatctctccataagatatgccctcttcatgcagttttttcattctggccgcaagatagcaggcgtcctgaaaagcatcatactggcgtctgactatgatcctgcttcccggctcccggactcctgtaagagggatgccgttctggagaaaacaccgggcagcttccaaaatagaggtactggaacggtagttgacgggaagcgcaagctcctttgcctgatatttgtgctttaaagtataaaatatctgaaaggcactgccccgccagctatagatcacctggtttggatcccccaccgcaaacaggctggctccgcggcttatgagaaggtccatgaagacaagctgctgggtgtcactgtcctggacttcatctactatgacccacttgggagatacagatttctgcttttcctccttcaggagaaaatttgcattttccaacaggtcaaaaaaagtcattttatcctgctttgccttctcctccccaagcagcccggcaagcttaaaaatatcatcctgatattttgaaacccttttttcctcctcccggacagccatggctgactctagtctttttttaaggcggttcttatattttatcttcagcttatactgcatgatcaggtcataggcaagctccagttcctcctcggggtctatgaccagaaactccttcgtataacccaggttctccacaggaaggaattcccgcagataatacagagctgtactgtgaaaggtgccgaaccccctgagcttatccgcaggcaggtccggttctgctgccaaaagtctggatttgatctcatctgctgctttatttgtaaaggtgagcactgtcatatcctcgtaacccaccccttttatatggtgcagatactggatcttggcgatcagcactgtcgtcttgccgctccccacgtttgcgttcaccacacaggcaggactctcatccagaaccgcttctctttgatatggattcagtctgtccagttctttttcaaaattcaattccatgctgtatcccccgcactgtcaaccgtttttcccgtcatgtaaatgcgaatatctccgtctgatcttttcctctgtgtccttcttattgctccccttgtctgacagacgcacttccaggcgaagggcagccggggcatctgtgtaaaaagcaatcatatttttcaggctctgcctgttggcgtcttccaggatccacatctgataaaaggtgctggatgtgggaagaaacaatatgtttccttcaatgtttacctcctccacagtattcaaaaatgctgccatggactctccattcctgctcagcaaagcgcagaattctttccatttggagggaagctccgcaaacgcgaacggtttctgcatataagtggagggcgcgtgttcgggcagtttcatccccatgggaggatccagttccatcagcagattttccagaccccagcgcacaatgcttttgtccagccgataatcacctacgcaggccgcgcagccgtctttacatttacagccgcttaccatctctatggcatgttctatgatcttcggcataagttcataggctttttccgcatatcccaggccgcccacatactcatcaaaaatatagaggcagacttcttcctcgatacctgcccccatatccagcgcattgcctgacatggtgatgcctatatcctcctgttctgtcatggttgccatccgggcagcattccgaagtgcatagcagacgccttcaaaatggttgtttctcaaaacctgtccgtttcctgtttcccttatcagactcctgtaaaccttcacaacatttgagggaatggtgatccaggtactttccgtgtcaaaatccttggacaagggctgctcaagctgcccgtatcccagattctgatggttgtggaactgcagttttttatacatgtaaacggattcctttacattgacatcgccgaatgaaacccttatccttttatattccttctctgcattcccatgtatgacacggatctctgcggcgcttcccggcatggtgtaatagtttccgcaaaagggtaccgcataggaggttttcgtctccctgtccatttgtacgatttcatactgggcgcctccgtgcatgtacactgcaccttcatggatctcccggaaagcctgcatctcatccatctctgtaatgatcctggaattctcccggtccaccagtttatatctgaccttatctatatttctaagactatagtcacctgccggaaatgtatctccggaccaggcaaatctgccatcctgggcatgcagctcttttacccgcagaagaaccggtatcgtctcacccagatcgggaaaaacagcgatatcatcaagagtaaggggcagttccgccgccgctgcccggatatgggcaagttcaatgagaagattgtctctgtccaccactgcgctctcgctctccccgtcaaaaagccagtccggattgatggagatatactggtcaaacggcaggttgtccaggatcagatagttggtacaggctctgccgcttcttccggctcttcctgtctgctgccagaaggaagctctggttcccggaaatccggcgagcacggttgtgtctattttaccgatgtctatgcccagctcaagagcgttggtggaaataaggccgcaaagctccccggccgtcattttcctttcaatctctttccgttctcttggggtatagcctccccggtagcctgaaatccgctctgtaagtcctgcaccgggaatgccctccccctccagcagatcacgggcttcttttaggataacttccacgtttctgcgggatttggcaaatgtgagaaagctctgtcccttctctgtcagctctgccgccatggacgccgccacagagttactctgcacctgcccgtaatactggttgtctttcccgtatatcttaggcggctggagaaaaacatattttttctccggagcaggggaaccgtccctgtcaatgcagagaaattccctctgacagactgcctgggcaagttccacagggtttgctatggtagcggaactgcagaggaactgaggagtggcgtgatagtatctgcatatcctggacaggcggcggaatacattggcaaggtgtgagccaaatgcaccgcggtatgtgtgcagctcgtctatgactatgtatttcaggtttgaaaagataaaatcaaagccggctttgctgtggttaggaaggaatgcgctgttgagcatctccgggttggtaaggatgatgttggcattcttcctgattcggctccgctcggcaggaggggtatcgccatcatatacccctgcggacagtctgtgctgtccaaatgcctccgtccagggttgtattgcccggtattggtcgcttgccagggcttttgtaggatacaggaaaatagccctggactggggattggtcagtatttcctgtatgacagggagaaggaatcccagggtcttgccgctggctgtggaggttgtgatgactatatttttcccctgcatggcctgggtaaacatctctgcctgatgagtgtagaggcttttgattcctgtggaggacaggtgggagcagatttcctctgacaggccggatggatatggggcatactgcgggggtgttgatgggatggttttttggtatacgattaaatcttctatttgcatggggaactcctgttgtttttttgtgagtgaggaacgtttgttcttagtttagcatttttggcggggagatgcaatgggggatgtggtccatgtgatttgggtggctcacggacggaaagagcagcggcccgggggcagggcaggcagggataattcatccgacgttccgctggcaggtagctaacctgctggcattcactaaattcgtcggcaaaggcctcctcattaagtgtctgccgcaggtggatctgcctgccgctccacttagcctactgaattatccctgcctgccctgcccccggaccgctgctctttcctgttggtggaatgcggatgggataaatgagtggaggttattttgattgtaaaggagatggatagacggaggttctctgggtcatgaatggaataaatgaacagaggttattgcgaatgtgaacaagatggataagaggaagttattcggattgtgaaggagatggatgagcagagattatttggattatgaaagagatggatgggtggaggttctttgagattgcggacgggatgaatgaacggaggttctttgggagtgcggatgggatggatgaacggaggttctttgagagtgcgggtgggatgaatggatggagattgtttggataaatgatggaatattgggattttagttgacattggggggtgatgtgttattatgaaagcatacgttttaaatcatatgttttaaatcgagtggtttaggacgagtgatatagcggatatttgaatattattagggatggagtgatgagggatgccgcctaaggctaagtttactagggaagagattgtgaatgcgggattgagtatcgtgaggaaaagggggatgggtgcggttacggccagggagctggggatggagctggggagttctgccagacctgtgtttactgtgtttcagagtatggaagaggtacaggaagagattgtacgggctgctaaggatgtttataaccggtgtgtgaagcagggactttcacaggagatggcttttaagagtgtggggatggaatatatcggattcgccagaagggagcctcagcttttccggcttttgtttatgagagagagggcggagacacccggggtgaaggatgtgctttttgcaattgatgataatcatgaagagatcctgcattcgattcaggcacagtatggactgaacgaggaggacgcatgggctttgtatcggcatttgtggatttatacacatgggatcgctgcactctgcgcaacaaatgtctgcagctttgaggaggaggagattgaaaaaatggtgacagaaatttttataggcgtattgaaaaatataaaggcaggtgaacggtatgatcagagcttgtgatatttttaagtcttacggaagcagtgacaactctctgcccgtgctcagggggatttctctggacatagaggagggagagtttgctgtcatcctgggagcttccggctcaggaaaatccacattactgaatgttctgtccggactggagacgccggataaaggagacgtgttctatggcgaaaaaaaaattacaggacttagtgaaagcgagctgacacagttccggaaagaatatgtgggatttattttccagcagtattatctcctgcctcacatgaacgtggataagaatgtgaagatgggagctgatctgtcgggaaataaggattaccgggatatgatcaaagcggtagggcttggtgataaactggaaaaactgccgggagaactcagcggcggggaacagcagcgtgtctctgttgcaagggcattggcgaaaaaacctaaagtgctgtttctggatgaacctaccggggctttggatgaggaaaccggaaggctggtactggattatatctgtaagctgcaggacatgtacggttttacagtcgtcatggttacacataatcagaatattgcccagatggctcataaggtgatcctgatgaacagcggcaaagtcacagatttatataggaatgccgccccgaaaactgcttatgagataggatggtgatcatatggtcgtaggattcagagacgcagcgaaatttaccgggatttttattatatcctgctgtgcagtcttcgtctgcaccttgttcctgaattttaatatggatatggctgggatacgggatgagatcacgccgggggcagttactgtattttatgaagcccaggtctcatccggcaagatgatcagttgtgtgagcggaggttgtcttttgcttacttctgttatcatgttatttttttatattaagcattatattgactgtcaccgaaaagaactgggcatcctgaaggctctgggatattccgattttaagattgcccgaggcttctgggtatttggactttgtgtgctgttgggtaccggtattggatttgcctcctcttttttactgatgcctaccttttacagggtgatgaatgaagataagatcctgccagacattgccgtccattttcattgggcgctgctcttttttcttgttctgatccctgcgggatttttttccattctcgcggtcctctatggatgccgtaaactcggaagccctgtgctgactctgcttcgcggtaaacagggcggaattttcaagctaaggcgacaaaaaggtaacagccggaagtcactttcctttttgcaggatctgaggcagagcactgccagaagccgtatctctcttttattttttattggatttgcttctttctgttactcttccatgatgcagatgacttttggtatgaaggaactggccagtgccatgtttgctgtgatcatttttgtcattggtatcgtgctttcctttacaacgcttcttctgtctgtcacaacagtggtggatgccaacacaaagacgatcgctatgatgcgggtgttcggatattcccagaaggactgccggaaggcgatccttgatggatacaggcctgtggcttatggaggatttgctgttggaaccatgtatcagtatgtactgataaaaagtatggttaagatcatctataaggatattcccaatgttccggattacacctttaactggcaggcgttttttattgttttattttcttttattttggtttatgaatttatcatgctgtgttattctgttagaataaagaacatttctttaaaggaaattatgctggagtgacttttccttttgagatgatcaaatacaagatcaggaggctctcagatgaaattaactgttctggtggacaataacacgtatatcgaccaatattatgcaggggaaccggcagtgagctattacatagagattgatgatctaaaaatcctctttgataccggctactcccatttcttcataaaaaatgctgtttccatgggtatagacttaaatgctgtcacgcatatcgtgctctcccacggtcataatgaccacagcagaggcttaaaatacctgcgtgaacaatatgcccttccaaatgcccggttggtggcccatcctctgtgtttccggccaaaatactatgagaacgaatacataggtgcccccttttccctggaagagatcaacaggctgttctgttatcagcccgctgaggcgcctgtttttctctcggaaaactgtattttcttgggtcagattccggagctttacagctttgaaaagcgaaaggccatcggcacgaccataatagacggcgcggaaatggaggacctctgcctggacgattccgcactggtgtgcaggacggataaagggctttttattgtcaccggctgttcccacagtggtatctgcagtatcacagatcacacccgcaaagtctgccaggatcagcgtattacaggtatcataggcggatttcatctgtttgacacagactcaaagcttgaggaaaccattcgttttctgagcgacctgtctccggatatgctgtatccctgccactgtgtttccctgaaagccaaggcccagatgctgaagtatatggacattgaagaggtgggtgttggactgaccatacaattatagacagcaggtgacagcatgttcaaaataggtgaattttcaaaattgacacaggtatccatccgcatgctgcggtattacgacgaggccggtctactgaagccttccagcactgacccctggaccggctaccgtatgtactctgcccagcagatccccaccctgaataagatcatttatctgcgggacagcggtttccaggttgcggagattgccgctgcccttgcagcagatagtgaaacttccctgatggagcagttggaccgaaaatatgcggaaatccaaaaaaacattcaggcagaacaggataagcttcaaaaaatagaacttgcaaaaaaagatatcctacatgaaaaaaatgaaatgcagtaccatgtcttcataaaatccatccctgccgttcaggtactttccctcagacgcgtcctcccggattactatgcggagggcattttgtggaaggagatgtgccttttcgcagaggaaaacaagatccaggtctcacccaataccttttccatttaccacgacagggaatacaaagagacagaagtcgatgtggaaatatgcgcacctgttaaaaaagcgggaaagagcaccaaagattttacctttcgccttacggatccggtgccttctatggcctgcacaatggtttacggtcccttttccaacatagccggggcctatctctcctttgcccgatggctgcagaaaaaccaccgctaccaaatgacaggacagagcagacagattgtccaccggggtccatggaatgaagaaaatcctcaaaattatctgacagaaatacaaatcccattggaaataaaatccacctcttgactctcacaccgtgtcagggtctatattgaccttacaaataagtgatatatggaggaaaacacaatgacaacataccaggtacatcccatcgggaccatccacaatgatcaggaagaggcgtttataacccttgatccggaatacctcccggcactgcaggctttagacggtttcagtcacattgaagttctctggtggttcagtgattttgacaacaaagaagcccgctccgtgctggaaacagagcagccctacaaaaaggcacctgccgtcctgggcatctttgccaccaggtcacccatacgccccaatcccatagccctcacaacagcccaggtcacatatattgatcatgagaacggtgtgatcggcctggcctacatagacgccaatgacaacactccactcctggacatcaagccctacacgcccagcatggaccgcatagaatcaccaacagttcccgactggtgcagccactggcccaaaagcctggaggaatcctctgattttccctgggaaaatgaattcaacttctaaaataaagcaatggggcgtctgctaaagacaccccatctgccattcttactcatgcctgtcttcccacaagctatataagagcctatatcactcctttttgcagcatcacattggcatagacagcgctttcccctgtagccacgatagcgtaagctttccttgcctcctcgtaaaaggcaaatctctccacattttggatcacacggtctccacgctcttcatactttctcacaatctccctgtaagtatcccagattggcgtctccgcatcatccccgggcataacctccataagactcatggggtgctccacatacccatccaggggaatcaggctcagcaccgcgtccagcacctccggcacaccatggccgtccatccggataacaatgcagtcctttcccatactctccgcaggaaaattcccatccgcgatcacgatcctgtcactatgtcccatctctgccagtacctttaaaagctctggcggcacaatcttcggaattcctttcagcatctcattcaccattttccttcacattatttttcttcagaagtatatttcttatatccgggatgtcttcctgtcacgccatatccctttctcatggagatcagtctgtcgatattttcccgagagatttcctttgctccgccaagcagatgcgcattcaaactgatctgcgcaaaaagttccagggtttccatccgataataagcggtgatcacatccgcccccactgtcagtgctccatgattctgcagaagcacagcgtcgtgttcccccagataaggagcgatcgcttccggcacttcataagtggagggcgttccatacggagttacaggcacagatcccagagcaatcacagtttcaatcatggaatattcatcaagagccttattcgccaccgcaaatcctgtggctacaggcggatgtgcatgcaggacagctcccacgtcttccctctcctgataacagcgaagatgcatcttgatctctgaagaaggacgacagcaatcctcagcttccagaatatttccttctttgtcaatgtgcaccagcttttccggggtgataaaacttttgctcatccccgtaggggttgccagaaatgtcccgtcctctatttttacggaaacattcccgtcgtttgccgccacccagcctttttgccacattttatggcatacatcgcaaatcagttccctaagctccatataacttaattccatttcatttcctccatttttgtctcaaaaaatgttgctattcacagccctggaaaaagcgcagtgctgtgaacagtaaccagaaaatccctgctgcatttctatgtattcccgctctaccggacaattgtttcatactgaccgtaggcctcctgccactgctccgtgtcctgtggctcatacaccttcatattctcagaatttcggatgatcctccgtacctctttcagatcctttacttcccctgccgccacaagctgcatggccaaatttccatagaccgtggcctccacaggcccggcgatcacaggaatgccgcaggcattggcagtcatctggcacaaaagggcgctctgggcgccgccgcctaccaggtgaaccgcctgataggtcctgcctgcgcatgcacagacttcgtccaggaccatcctgtatttcagcgcaaggctttcgtcaatacagcgcaccacctggcccacacgctccggagccttctgccctgtacgcctgcagaactcccggatccggcggggaatattccctgaaggcacaaactccggcgcatctgggtccacaaaagagacaaacggctctgcgtctcctgccatggattccagatgcccaaaactatattcgcatccctcacgcatccactgtctccggctctcctggatcagccacagaccgatgatatttttcaaaaatgatgtcttgccgccgcagccgccttcatttgtcatattgcaggcaaatgatcttttgtcgatctgaggcacattaagctctgttcccagcaaagaccaggtaccgcagcttaaaaacaggaagtcatctgtctctgccgggacggcagccatcgcgctctgggtatcatggcctgccactgctatgacatccatagatcccacacccagctccttttggatctcatttctcagactgcccagccgggttcccggcatgagcactggttttaatatccgggagggaaggcccaaaccttccagtacctctttggaccagtcttttttagcggcatccagcatctgtgtggttgaagcgatggtatactcgctccccatttcccctgacaggaaatacgaaaacagatccggcattaaaagcatattctctgcctgttccaacagctcttttctgtactcctgctctgccatgagctgaaatgctgtattgatctccataaactgactccctgttatctcgtagagcctctccctgtccatacgcgaaaacgccattttcagcattccctctgtccgagaatccctgtagtggaccggattggataaaagcatgccgtctttccccagcaaaccatagtccacgccccaggtatccacaccgatactgcttatatccgcgcctgacctgccctgcatgatcccagcctttgtgatccctgtcttcagctcatgaaaaagccgcagaaaatcccagtacatggtactgttgttttttccgtttaagatcacaggctcgtttgcaaagcggtgaacctcctgcagagaaattttctccccgtcaaagctgcccagcatcaccctgccgccggaggccccgtaatctgctgccagcatctgttttcccagcatttttatcttccttcctattttttccttcttatttataaagcgggccgtaagctgcacatgctctgtagtcctgcccctctttatccatgccaaacgcgttccatgctgcaggacggaagattttttcctccggaacattgtgcatagccactggaattctgagcatggagcacatggtgatcaaatctgccccgatatggccatagctgatggcgccgtggttggctccccagttgttcatcacatcgtaagccgtcttaaaagcgccctctccactgactctcggtgcaaaccatgtacacggccaggtgtaatccgtacgtttccagatcgtgtcagatacctcggcaggaagcttgatggtccatccctctgcgatctgcagcaccggtcccagtccttttatcaggttcagccggatcatagtcactggcatctccgcatctgtcaggaatctggaggaataaccgccgccgcggaaatatccgaaatctgctgcattccaggtagctgccttcataatagcgtcctggtcttcctctgtcacatcaaaccatggcttgatcacactattttcgttttcatcctttgcttccccgcaggcatccaggcaggctgcgccggagttgatcagatgtatgaaaccgccggcctgcgctgctttgccctccagtgtgtagcctgtagcttcctttacagcttccgggctccagtatgtacgcacgtctgcaaaaatctgcgctctgttggtgagcagcttcataaacatcattcccagaccattgagtacatcgttctctgtagccagaatgtatggctctctggctccgttccagtcaaaggaggtgttcagcatggcttccgcaaagtccgcgttgggataaaagtctgtccactgtctctgtccctggaagccggctgccaatgcattgtgtcccaccttctcctcctcgcatccctcgggaagattctcatttccgttcattaaatccttgatgatgcacatcatcttcactacaaattcccagtcagaatccttctgttctctgctcttctgcactgcctccgggttcttgtcaaatccctcgatacagtgctcttttgtccaggccaatgcctttttatactcttcctcatcatagatgccctctgccatacggcggatcaattccacttcatctacagattccacccgcattcccagataagattcaatgaaatccgggtcaatgatagaaccgccgatccccatggttacagaaccgatctgcagataggatttgcctctcatggatgctgccgccactgccgcacggccgaaacgcagaagcttttccctgacatcatcgggaatatccgtggcatctgctgcctgtacgtcatggccgtagatcccgaatgccggaagccccttctgcgcatgagtggccagcacgcttgccaggtatacggcacccgggcgctctgtcccgttaaatccccagactgcttttatggtctgcgggtccatatccatggtctctgctccataacaccagcacggtgtcacagtcagcgtaatgtcaacgccttcccttctgaatttgtccgcacaggctgccgcctctgccacacgtcctatggtggtgtccgcaaggacaacttttaccggctcaccgtttgaatatttcagattctcctccaaaaggcgtgcggcagaccttgccatattcatagtctgttcttccagggattccctcactttcagataccctcttctgccgtcaatggttggtctgatcccgatcacaggatatgctccgatcaatctgctttttgccatttttctctacctccatacttgtaatagttggttactacctcccaggactgtggttgtgaatagtaactaatgttcactatagttttcttatattctcatcctaaacttgtttcaaacatatttcctgtgatataatggcaaaaaacaggacaatattcacctttttgagaactatcaggaggcacctatgcactatctggattacaatgaaaaacaggcccacggcacagcggattttcctcttgcctactattatgtggatgaacaccacccccgctatcacatgccctttcactggcacagggagaccgaactgctccgtgttctggaaggacagctccgcctcagtctggatgaccgggagtatgtggtgagcgccggggaacttatctgtatcagcgagggtgtcattcacggcggggaaccggaaaactgtatctatgaatgcgcggtttttgatcctcagcccctgctcatgcacacccatgcagtccgcagctacctctatcagatccagcgccgccagatacagatactcatgcgcttcacaaaaaaacagcccgaaatcctcacctgcgcagacaccctgtatcattccctgcgcaaaaaaggccccggatgggaaatgacttccctcggagcactttttgaactctatggattgatatttgaccggggatattataccccctgtgcctcccgtgacaatacacagggaaagctccagcagttaaagcctgtgctggaatatattgagctgaattatcaaagccccataaccctggaggatttatccagactggccggcatgtcctccaaatacttctgccgttttttccgtgcggtcatccacaggacgcctattgactatctgaactattaccgcatcgaacgggcctgttatctcatggccgcggaaggcatctctgtcacggaagcagcctatcaatgcggattcaatgacagcagctattttgtcagggctttcagaaaatacagaaacgtgacacccagacaatatcttaaccgtctggaaagttctgattaatacctctttattttcttggaaggcgtcttttcaaattcttcctccctgatcttcagcccgtggatctttttataggggggaagtcctctgttaaagttgtcgatcacttcctgcagtttttctctcacatccctgatcctcttttttgaggcgtattcatagtccgggaaaatctctgcttcaatgacggattccgtctccctgacaatgatctcctttaccagcggcgatctgctgatttcattttccagctcctcaggggaaacattttctccgtttttcaggatgatcaggtttttcttccttcctgtcagaaatacgaaatcatcctgatccacatatcccagatcaccggtcttaagccagccgtcctccagagcttcctctgtctctgcgggcatcttgtaatatcccatcatgacactggaaccgcggacccagatttcctcgtccaccacctttgcctcacagtttggcagaagcctgcccacagatccttctttggaatcccactccaggttggtgctgatgaccggtgaacactctgtcattccatatccctgaagaatggtaatcccgtactcggcaaatgcccccaccatctccggaggaaggtaggctccgccgctgcatatggtttttaaattgccgccgaaagctgcctttgccaccattttcttcggcaggatgcctgtggactccttcagttttttataaatggattcgatcaccatggggactaaaagcacgatctcaggtttgaacagtttcatatttttagacacatgcatgatagagtcattgatgcagatgaccatgccgatatagattcctttcaggatatccatagtaaagcagtaggcatgatgaatgggaagaagtgtcatggacactgtgcctgccggaatcttcatatccagacagactgcattgtccgtcagattacggtgtgtgagcattacccctttgctctttcccgttgtgcctgaggtaaataaaatggcgcatagtttgtcagggtccagttcacaggaaaaactcccggcatgttttttcagaagaccggtgagggacaagacctgttctttgtccttttctgcctgcatggaaaccatgaaccggacttggggacatttttcttttgccatctctgccacatccctgcgaagctcgtcatagaccagaacgctgatatccgccctgttcaaaagctcacacacatccgatgccggaagctgcgcatccagggggacgatcacacatccgctgttggccgctccaaaataggcaaggatccactcatatgtagtgggacctatgaccgccacgtgttttcccagcattcccatgctgtccaaagccctgcaaaaagcctcgctgtctctttttaagtccctgaatgtcctggttatcacttcttttctgactttatagcggatggcaggggcatccccataggtttctgccgcatagtcaatgatatccttcatagtgttgatctgaccgctcatagttcccctcctgtctagtcctgaagactttcgatgtagcgtacagcctctcctacggttctgatctccgctgcctgacgctcttccacctcaatgtcatatgtatcctccagttcccctatcatactcataaagtcataggaggtgaatcccagatcttccacaaacctggaattctccgtaactgcgtttttatcaacttccacatattcacagatcatatctttcagcttctcaaacatttctcatatcctccattcataatccaatcattacacagattctaaaatttctcccactgtcatatccgggttttccacccctttgaaaatgatacggcacagatagtaatacagatactgcaggtcctcaaaatgcacgacaccagtctggtgttcaaaattaaagttcataccattgtcctccgccctgtgcataaccgtcaggtaaagagcatgggctgctgccccgttgctgtaccaggcggatttgtactggatatcctgcagacgctccatcccttttcccttcagtgtcaaaggctggtacgtcagacttaagggttcataggtctgtcccgatcttaatttgtaatacttattcctgtacgcataataggctgtcgggtcatagtttgcatgacggaagatccggttctgcccgtccctgatctttttaaggccttccataaaggtatcacctttttccaccactgtgcggaacgggaagcagtgtatcctggtacctccgcatctcttttccgacagagtggctcttcttgccactgtggtgttgatagaaacatcatcattgccgtttaccttttgcagatacgtgcgcagtcccatcatcagcaggcataccatggaaatgtgatgttcctcacagaactgcatcagccgattagaggggtctgcctccagttgaaatgtgataatgttggcatccacattgtctgagacattggtgactgccctgatatccggatttttttcctttccccgttctgccttcagcttacccgggccgaatatactgttgaaaataggttcggaggaggaaatcatcttctcaaagaactccgtgtcacgtttctttgccctggaatccgcctcatactccaggtcctttttaagctgctctatgtatgatttcatctccttcggatattccatgccttcatatttcatgttggcatatatctctatgacatccttgagaaataggatcagggactgggcatccatggtcatatggtccaccagcagatagataccctggaatccatccggcgtgatgatcataactacccggtttaaaggggaatcaaatctttcaaaaggcacggaagtccactccttcatcttatcttctgcatggcactcctgccatccggtaaaatcaaagaattcaatatccctctcctcccggtcagcaatgtactgatacaccccgccgtcttcatcctgtgtaaagcgcagacgcatggactcgcatctggcataagcctggtatacagcctccttcagtgctccaaaatccagactctgctgaatagtaagactggtaccgatattcagcacctgctttttcggacagtatttctgatagaaaaagtgcagcttctgggctgctgtcagcggatacagtggtttgccgaatttctctttcatatgtcaaactcctctcttagatcagacgggaaccgaatccccggtgcttccctctccggttacatcagatacataaatactttttcctgcaggcgcccaggcctcccctgccgtctccagaaactctgtcagcttctgttcgtaaagcgcctgttctttatagaaggcttccacatggcctgctccgtgtacgatcagcatatctttcttggacgcacagtttttataaatctcatagcacattctgcacggaacaaaagtatccgcatccccatggataaagagtatgggaaccttcgctctctttacttcctcggacgcactgcactgcttcagcccgtatcctgccttctttctgcacatgctgtctgacagtttcaggatcggataagccggcagatggtattggtccttcagtacatgggcaaatacatcccaggcagtggtaaaggcgcagtccgagacaatccctctcacctgaggcggaagcttcagcccgcttgccatgagaaccgtggatgctcccatggaagtgccgtgaagccatatctggcagccgctgccaaaacgcttgactgcgtacgttatccagagaagcgcatcctccctgtccagacacccaaatccaatgtacgtcccttcgctgtccccgtgtgccctttcatccaccagaagcatctgatatcctctgggcaggtaatagttggacaatccgatgtaatcactcatgcccttgctggtatatccgtgaaaacagatcacaagcttcccgcttccctgccccggaaaatacgttccgtgaagcttcaggccgtcaccggatctgatatacacatcctcccgctcctgttccagcatccactgtttcatcttccctatctcaggtatatagaggtcccagttcgtccccgccatatccatggttctcttggtggcggcattctgccgaagcatggtccgcctgaaaaaataagatgcaattccgtattcccctgcagcagccagtgcccctgctcccagtaacaagctccatccattcatagatactcctcctatcttcgcgtctgcctgcgcatccgcgttgaatggccatcagttacctatttcttctattttttcagcagtcttctgactgtttttttggctgtcttttcttctgttttctgtgctaccttttccactgccttctgcgattccttttccactgccttctgcgattccttttccactgccttctgcggttccttttcctctgctttctgcggttccttttcctctgctttctgctgtctcttttcctccgctttctgctgtctcttttcctccgccttcatcttctttttttctctgcctgcctgttttgagaatctctgaagcagcagagctttatcaaagctgccctctacctgcagttttcccagtgtgaatgctgcgacggcatccatggtgccggttgcaatactcagaagtgtatcggctgtagtagtgaacagcacatccctgtcgtaatattcatatggctctatgtacagctttccctccaaaacctccgcataaaaagctccctcagcctctccccggatgttaaactgataggcaatgtgctccttgatcccgctcacatctgcctgcataaaaattcccctaatctcactcactaattcctgatatgtcatctgtttttttcctcccaacatatttcgccatttttcgaccaccggtcgaattcaggttgtaaacaagataccactttttcgaccagtagtcaagtttacatttctgtgctaaaatgttactatcaaagaaaaacggagaaaggtatttatgcaaaacaatagaaaaaaggacatgatcctggatgcaatgcaaagattgatgaaccgatccagcgctcagtccatatctgtcagcgatgttgccaaagaagcggggatcggaaaggggagtatctactattatttcaaatcaaaggaggaaattcttgaggctgtcattgagcgctcttactccgctgccattgcaaaggcaaaaaatctgctggaaacccctgatatggaggccctgaccaaaatggagattattttccgcacctgccgggaatcctccatggagcttctgcgccaggaatccaataatttttttgagctgcagcaaagcgctcttctgcatcagcagtacatacgtatcatggtgagaaatctgcgccctatcctggcagacattatccgccagggcaaccgcgaggggtctatgcactgcaaatccccggaggaggtatcggagatcgtgcttatcatccttaccatcaaactggacaatcacctcacaagagacagccgggagcacacccaaaagacactggatgtattttcctatatgctggaaaccagttttcatattgaaaaaggaaaactggattatctgtggacggactgagatgccaaagaccaaaataaaaaaagtatacagaccggactccacctccggctgtatactctttttattatctcacagcttctataaaagttgctccttctatagaatccggcacatttaccttagaaaatcctgcctgtaaaagcagttctgtctcatgctccaacgtcagtggaatatcaaaatgcacaaactgttcctctgaaattccacctgcctttcgttttctctcacactcccggcgcagaagattttcttcctcctcacagcaggcgatataatccgcttccaggaaccttcctccgggcttcagtgctaccctgatcttttcaaagagcagcctcttcttcccaggcaggaaatggtgcagagactcaaaagaaatcaccatatcatagcagctctccccaaaagattcctgaaaataatccccgcagacaagagtaatatccttttccctgtatttgtgtctcagccggtccagcatggtgctgcacaaatctatccctgtcacctggatatggggatacttactgaagatagattccagctccaagcccgtcccgcatcccaaatccagcattctttttgtgtcacggtctatccagccggggattcttgcgtaagcctccctccaggtctgcatccgttcctcataagacccaatgcgccgctgaaaaaatcctgccatctcctcaagaggtgtatctttttcctgctccagccactcccgcagttcccgcatatattgttccatgtcttcccttatcactacagccattcttgatctcctccctgtatttcttttcggtattcttctattgtacaggccgtactgccggaaatccacctcacaaacaattctatttatatttgatcttctctccttcagatccgcaacgatccgtctggcaagcgcccggtgatccacatcaacgaccatctcagaacccagaatctcttttatcccgctgctcatgaattccgtcaccttttccctgccttttgggggcgcataaacgccgtgataagaattcattagatttttattctgcctttatttctctctccagcaaatcccgctcaatctgcggatacatcttatccagcttatataccagcaggatcagcactgctgcgctccacacaatgatgggaccaaactgatagatctttccgatcgtcctcacagcggactccggctgcaccacctgtgccccggttgagctgatatagccgctcaatgtcatcaggcctgtcattatagcgcttgtgataccggttcccaccttgaatcccagacttgcaccgccgaatacaagactttcctggcggaatccatttttccagcagccatactccaccacatctcccaacatgccgaaaatagtggctgagagctgggaggctccgatagaacggatgagtgtcacgaaaaacaaccattggaaattataagggttggccagcaccagaagttgtgaaccgactgctataaggcagcccgccagggtgacatttcttttcccccatcttttgatcagaaacgggcagactgctgcgccgccgatcatgcacacagtttccagaaaatacagggtgctgtacatccaagtgtcatttccaaagatatatttacagtaatacggcagatctgttccgacaatcgtcatatggatgacctgaatagaccacagcccaagcacgcaccagaaatacttgtttgtcaccagagcctttatgttcaccccgacggaacgcttttcctcttttttcgcctctgtcaccacagtctcctcacaccggaagaaacagtacaacagcagcgctacagcaatggcgacccagatacacatagtcttaacccatgcagactggtcatttccaaacactttcacaagaggcatggtaaaagtcactgagatgatacgtcccaccggtgataaaatcatgcggaaaatggaaagcagatcctgctggtatgaatccctagtcatcatggttgagagcgatccgtatggaacattgatcgccgtgtagataaccgtcgttgtcaggttataggttacaaatatgtagataccttttacaaactctgtagtgtgcggcactgtaaacataaggatcgccgctatggcatagggaaccgtcatccacaggatccatggtcttgattttccccattttgactttgtcctgtccactaaaaatcccataatcagatctgaactgccgtcaaatactcttgacaccagcatgacaataccgatggtcaccggtgaaatccccgcataatctgtataaaacaatgtcagcagcgtggatatcattccatacacaatattacaggccgtatccccgcatccgtaagctactctcgtcccaaaggttatcttcttcttcataatgacctccccgccacatgatctctcaatttatttttcagcacgcttccatgatcgccttcacagccgaagctgtatctgtcagcggaaacaattcataacccacatatcctgtataaccgcacgcttctaaatgacgcagtacctttttataattgatctcaccagtacccggttcatgtcttcccggtgcgtctgccacatggatatgtccgaactggtctttgtaattggagatggtatcacagatacatccttcatttatctgcatatgatacacgtcgtagaggagctttaatctcggtgagccgatgagccggcagatttcggcgcccatctgtgtgtgttcaagaaagtttccgacatggtctgtagtaatattcagagcttccaggttcaggtttatcccttctttttctgccactttcacgcagtccataagggtacggtacatggaacagagcttcaccgtgtgggaaagatcatcatagtggtttaccacaatccctccgtctcccagggcattggaatgaacggtcacactgccggcccccacagctttcgctgcacggatggactccttcagatattctacatacttttctctgtgatccggatcaaccagggaatagtccgcatctccgttaaagccactgacagaaatcccggcctcatctgctgctttctttgtggctttcagatcacgggttctccagtcccagaactccacagcgtcaaatccatccctctttgctgccccgaatctctcctcccagggcagttctgtatacagagtatcaatacaggcacattttctcagactcatcttccctctacctcctcaatctttacaggtcttccctctttcagggattttgtggccgccgctgccatcagtaccggatacagtccatccatcccggtaaccggtgtctccttatcattttccacagcatctgcgaatgcctgaatttctgatacaaatgcacctgtatagcggtcccacatcaccttatatgtattctcacaactggttcccacggcatctgagagtttaactgtattcggcacatcattttcattgcgggcacatccttcggaaccgaacacttccactctctgatcatacccatagacagcctttctgctgttgtcaatggttgcgatgatcccgttgtcaaacttcagcacgacaacagccgtatccacgtctcccgcttccccgatagctgggtcgatcagcacagagcctgctgccataacctcggttacctcagcacctcctgccagaaaacgggccatatcaaaatcgtggatcatcatatcataaaaaatcccgccggacaccttcacatattcaatggcaggtggctccgggtctcttgagctaattttgatcatctgcactttccccactctgccggactgcaccatgtcataaacccctctgtgattatggtcaaatctgcggcagaatccaatctgcagcttcacacctgcatcctctgcagtctggatcgcttctcttactttgtccaaatcgtagtctattggtttttcacaaaaaatatgctttcctgccctggctgcttctataatatatttagagtgcgtatctgtggaagaacagatcaaaactgcctcgatctcctcatcctgaaaaatgtcctccgcattctttgtcacgttctgcacaccgcattttctcagaaacttctctgtctcctcattcataaacggatccgcaactgtcttgatctcaacctccggcacaaacatagagatattttttgcatgtacctttccgattctccctgctccaatgattcctactttcatctcaatacgctcctttactctccatcattttgttttcgcccgcctgcttcagttggcccgaacacggacgcacaggactgcatctcagcatatcctctgttactgtcttcattttcctttttttgtgcttttgcatctcatgtgcttttgcacttataattataggagagactatgtgctttgtcaacatttccgcctttgttttttcatttttagctacatttcacaaatttgtgcttttgaacatcccattttatcaggtcttaccgctttttcttttgttaaacttagccaattcccctatttacaatcctctcctccatatgatagaattcatttataaaataaaaatgtcatccacgtgcaatagcacgcgcatataaacaggaggaatcatgataaacaaaaagccaactatacaaatggttgctgacaaagcgggagtttcccggggaacagtcgaccgggttctcaacaaccgttcccatgtaagtcctgatgtttacgaaagagtcatggccgccattcaggagacaggctatctcactcccaggagcacctatcagaaaactctgttcggccagggattcccgccgatcaagcttggcgtgctcctgcccaactggaccggtcacttccgctgggagatcatgcgcggcatcgaagctgcccaggcagagcttaccgatttccatgtaaagatcctggtagaagaatgtgaaactgatattccggaggaaagtatcgaaaagctggacgctctcttgaaagaaggcattcagggcgcagccgtctgtaccatgaacgactcgtctattgaggagaagatccgatcccttacagaaaaagacattccggtcattacttttaacagcgatctccccggcactgacagactctgctttattggtcaggactatacaaaaagcggccggatcgccgccgaactcatgagcaaatgcattcccccatccggcaaaatacttgccgcggccggcaacctggaattcgacgggcaccgtgcccgcctggacggtttccgcacccgcatggctgagattggtttcccacaggaccagatccaggtcatagaaacctacaataactatcagctcacctacaaaaaagtcctggaggctcttcagacggacgactccataaaagctatctatatggcaaaccgcagtgtagccggctgtaccaaagcagtggaaaccgcacaaaaaaaaggaaagatccgtatcatctgccacgacatgtcagaacatacaagatctctccttctggatggaaccatagacttttccatctcccaggaccttcaccgccagggttaccttcccttgatatatttaagggactatcttcacaaacaaaagcttccgcctgcccaggatactgctgccaatatctccatcctctgctcacaaaacctgtaacagcgcagcgtcggcagtgtgaaccggctgatggttcgcactgccttcatatcataataatctccattccgccgccaagtcggcggcacaaatagtaatgaaagtattccaacttctactctttggtgtaaaatagcttgtgagaagctacactacaaagcacgggaggagaagttgtaataactttcttcgttttagacagcataataatcagtgtaagttctgccttttcaagcacaaataagtggtactatgagtccgcacactaagaattgtttaagcgccttagtttaattgtgtggcagttcagtcaatggcctctcttcttttacgaaaggagtctgacttatgaaagttgtttatcaaacctgttgtggtgtcgatgttcacaaatcttttctcgttgccacaatcattaaaaccacttccggtgtggaaccttcgtatcaaaagaagcgtttctccacctttaacaattctattcttgaattcaagcactggcttctcgacaataactgcaaggatgtctgtatggaatccaccggtaaatattggatccctgtctttaaccttttagaagacgaaataaacgtcaccatcgctaaccctaaatgggtaaaagctgtcaaaggcaataaagatgatacgaaagattccaaatggattggtgacttgttccgtcttggacttgtgagaggcagttatgttccttgtaagaccatccgtattttacgtgaatatactcggtatcgctacaaacttgtttcctgccgtaccagtgaaaagaacagatatcagaatgcgctcactgtctgtaatgtcgcattagattcagtagtttccgatatcttcgggaagtcatccacatccattattgactacctgcttgaacagtccggtcactctattaaccacgaagaaatcgcatcaaaacttcttagacgtctcaaatctaaaacagatgccgttatagaatccatcgagggatatcagatgactgatgcccaaaaataccgtatgcgcctcgtccgcgcacatatggattatatcacagccgaaatcactgatatagactctatgatagaaaatctgatttcttctgatcctgattatgaaaatactgttcagttactctgtaccattccgggtgtaaaacatgacagtgcaatcactatcatctccgaaatcggtattgatatgactcagttctgtacctcaaagcgtttatgctgctgggccggattaactccggggagcaacgaatctgggggtaagaagaaatctgttcgcattactcgtgctggtgtctacctcaaacctgcattagtacaatgcgctcatgcggccgtgaaatccgaccaatctccttactacaaaaagaaatatgaatctcttgtaaaacgtcgtggtaaaaaacgtgccattattgctatcgcccggatgattctcactgctatctatcagatgttatctactggggaaacatggaatccgaccgatttatttaaaattgatatgcctgaggttttgcttgaaaagcaaaaacaaaaggctatcaaacaagcgcagaagttactgatacgcgaagggttattacctccattggaacccctggcttcctaaactaattatctgatctatacttttttacaggttaccatttctggtagcttattaaagtacgtcactttttggctatcctctactttctttcacactattcttctcttatcctcttccggttcacccaaaagaaatatcccacacataaaatgatctgcaccgctgaagaacaaggcgtagccagtcccacaccaaacaacgaaaccggcaccattcggctcatgagaaacgataccgggatcctcaccccaaaagcgcccacgattccctgcaccatcacaaacaatgtcttcccgcaaccgttaaaatatccgatcatacaaaacattacggagaccaacaggcagtcaatggcatacgccttcaaatattctgctgaagccgcaataacctctgcatccctggcaaagatccctgacaggatatccccgtggaaaaacgcgccataagccatcaggactcccactgccagcgacattccgattccgcacagaagggccttctttgcccttccagattcccctgcccccatattctgggaaacgaatgctgccatagactgattaaaggcagacggcacaagcatgataaacccacacagcttctccgccacgcccaccccggctgacggtatcacacccagcgaattgacgatagctgtgatcgccagaaatgaaattcctaccaacacatcctgaaacgcaatggggaatcccagccgaaacacttctcccatccgtttcctgtcaaatacaatgtcccttttatgaaatacaaacggaaattttctctttctgatgatctgaagcgagatcaccacactcagcacctgggcaagcactgtggcaatggcagctcccgcagtggccatgcccaaaacacccaccagcagcaaatctccggctatgttaaatacacaggcaatagccactgtaagaagcggcatcctggaatccccaagtcctctgaaaatacttccgatgacattatatgccacaataaataaagctccggccgagcatatcctcacataagagactgttgcgtcaaacgcctccggcggtgtctgcatgatccttgcaatgggcactgcaaaagcttccatgacaacagttatcactacaccgatgacaatgaaaagcatgatgcttgccccaatgatctttccgccttcctcagctcttccctcaccgatttttcttcccagtaaaatcgtagttcccatggcgattcccaccacaaacgctgtgataagctgcatcagccagcttcccgtagaaacagccgagacatcagccgcctgggcgaactgtcccacgaccagcatgtccaccgccccatacatggtctgcagaaaaatagctgccagcaccggcagagcgaacttaacaagcggcatcaggatttttccttttgtaaaattctgtccttgactcatactctcatttttctccttttgctcgtaatgtacattccacggaggctttcacactataatgggccataaacccacacaaaaaaccggataagaggcaggcatttcagccagcatcttatccggttaccatttctttcagaatggttcaccctccgatgaacgctgtcattatataacatgactttttatttgtcaagattcttccggcgctgtcagggggatttccaaatgttattgtacttttaaatcatcaattgtaaatctctcgtattttaatatattttttaaatgcagttcatttcgtgaccatgagtcgtacttctcatataacaaaccaatctctccatttggcagttctgtcagacaggaatacgaatatcccattttcggatcatcaatggaatagcaatacttccactcaacagaatatttgtttattccggtttcacctgtgtcgtttatcaggccgatccaaattttaccgtttttccggccttccacagcattcggtgaagataaaagaatggctggttttccatcaaccagttcggaataatttataacagataactgtgtgccataagaagttgtactgatctctgtcagaggaactctgtcactccatgtctctcctccgtctacacttgtcacttcagcaatatagccggaacctgtgcgaagatatgttttcagtgagccgtccggcatttcaacgatctgtgcctctgctgtggctccgcctgtcctgtcatcagcttccacatatgtccaattctcaccatggtcatcgctatacataaatccaagttctgcggaagatttggaatataaaggaaccaacagccttcctgcatattcacctgttgtaatctgctttccgacaccgggtcccactactaagaatttagactcctccggtttgaacgtactaacaatattcaggtcagaccatgtttccccttcatcatctgaatatctcatggccagataatttgtcggaaacgctttgaaaacggagtctttatagaatatattcatatttacatcagtatctgtctgcgtctccaaaagtgttgacccctcaaagttataatcatactgtttgcaggtcagattgtttccgttctgataaatattatattctccgtctactgtatattctgtagcttcccctgttgtatcattatagataataccactttcgcggattgaataattgtaagcatccgctccgtcttcataccatctgagcttcagatattttttaccgtctacctctttaaatccagatcctacagaagcatttgagcttccgatccctgccggcatcagatcggcaaaaagaaatacccttttcgtttccttgtcctccagcaataccgggtcaatataagatgcgcttccctgtatctgaacatttttccctacagagtccctgggccagtctatattctttgcaatataatcctggaactccaacggcagtgtaggctgctcccatgtgattccgccgtctgtactcttggcaaacgcaatattaattttactttttgaatcatgggtaccgccatatctggcatctgccgctgccaaaacagtccctgaatctaatgttagcagggatgggattctaaaataattggattgcgtggcatctcccgcatagaaaatattgtcagcataagcggtctcccctgttgtctgaatcagttcctcgtctgaaaggacattattgtatacccggatatttcctatggtgcctccaaaaggataagccacactgccctgacgtattgttcctcccagggtaacattgtttaccccggtgatatcactgataaatttaaaatcatccttgtccaaaacatccaggagctcaccatttgcaaacaacttatactgtttattttctgcgtctgctttaaacgcaacagtattatacacccgttctcctttgtaaagcccccgtactgcggcaggcctgtcaagagtatatttaaacacgccgtctgtatttctcagctccattcccacaccgcctgcatttgtcacatagatatgaaaatgcctgttctgatttcctgaagtaccgttacccacactaaacaaagactggattgcattttcacttgtagactgataagtgatcacaattgtcccctgcgttaacgcttttacgtattctgcaccctgctcttcatccaggctgtatccctgtccttcaggtatctcaatattttccttctccaaaacaagcgtttccatagaatcattcacagcctctgtatccacgctctcttgcccgttgtctgattcctgtgcaggtttttccccctgctctgccgctgtttccgcgtcagtacctaatagattttggctatcctctgcagcatatacattcaaagaagcggcacatactgccgaagcagctacaaatacaacaattctttttctgaatttatacatggctctactctcctataacttctctcagttgcactttgcggttctcatatctggacatggtacatgcatcggctgttgctatggcagcccttgccgcctctcctgtgagcagaggccggaattcgtcgtctgcctttgctccgtgcatgattccgtttaaatatttcatttcattcttcataatactgtgaagccacatgggtggttttttacctggttttccgtacataatggctccgtccatctcggtgccgtggtatattctggtacggtcatcatcctcctcctgggactcgtggacaagaaaatgctcctcttttccgtctacctttaatgtgcccccgcagtcacacatatcaatacggatcgcaccctttgtgccctggatcagcacatagtgctcgggccagtggaaggcagacccccactccaaaaccgcatagcgattatcagaaaattccatatttacaaacagcatgtcatcctcgtcaccgaactcctccccctggtgcgcaacatttccgcctgtcatggtaactgtttccggcattccgcccatgaggaactgtacacagtccagctcgtgaatgtgatgatacagatgtccccctgatttttcccttatctttttccaggagattgacggctgcggttcttcccatccgtttctggcagaatggcagtacaggacttttccgatcactccgtcgttgatcaattttttcgcatgacgcaccccccggaagaaattcatgacatggcccgccataaaggtaacaccgtgctgctgacacgcttttaccatctcgtcacagtccttatagctcagggcgataggcttttcacaaaaaacatttaccccgtgctctgccgcctttatgaccggttccttgtgcaggtaattaggtgttgccacgatcactgcctccacatcttcacggctgtacagggtatctaaatctgtttcaacgtcacatcccagctcctctgctacagactgggcgttttccgggtcaaggacagccacgatcctggctccttcctgctccttcataatacgtccaagctccgcgccgaaataaccggtacccacaattgcatatcctattgtcttcatatccattacctccaaatatatccaaagttattttactgctccgtcagtcatgccacctgcgatcttattctgtataaacataaagaatatcacggacggaaccacaaccagggcagatgctgccatcatatctccccagttcaggatttctgaaccctgaagagattttaacgccacagacactgtcatcttatctgtgctgttgatcaggatcaaagagtataaaaattcattccacgcattgataaatgtataaatagctgttgccacgattcccggcatgaccaggggcagtacaattctcacaaaagtctgaagcttattggctccgtccacccttgccgcttcctcgatccccagcggcactgtcttgaaaaagcctaccagcatccacacagcataaggtacgctgaaggagagatacacgatgacaagcccgactctggtattgacaaaacccagctttgccatgaccatagaatagggaatcgccagaaggatgggaggaaacatgtaagttgccaccagaacctttgacataatagaacccagcttcggaaaaaatcttacaattccgtatgccgccatggatgatatcactatggcaatgcaggtagttgatattgcaatgatcaaactgttgctgatatttcctccaaatcccaggtcctgaatcacatgggtaaagttttcaagtgtaaagtgctttggcagaaaacgggttggatttgcggtcagctctcccgaagattttacagaacacagtaaaacccataccagcgggaaaaaagcaatcatggacaaaatgatcaaatatacatggcagagtccattgccgatcttttctttttgatttgtcatcacttgtcctccttttcccattttccaatgatcgtaaagtaaaccacacaaaccagcagcaggaatgccagcaaaagcacagtaactgcagatgacctgcccagaagttttgttccccagcccatattatacgcatagacaggaactgtggtggtggcatttgcagggccgccccctgtaagaagatagataatatcaaagttattgaatacccaaatggtacgaagcactaccaacaggccgactacgatcttaatatgcggtaccgtaatatgccagaactgctggaacttggaagcaccgtcgatctgagccgcctcgtactggtcctggggaatggtctgcagcgcggacagcacatttaccatgatcatcggcgcgccgaaccagacattaataaaaatcaatgtcagaaataccaggctgctgtcacttaaaaactgcggaagttcgctgcagatgcccaactggacaagaaagttaggaaggaaacctgaaacaccattcagtatccatttccaggaaagtgcgatcacaatagaggggaatgcccagggaatgatcatcagggttctgtaaaccccctttccaatcttcacccgatgaatggccagcgctgctgtaaatccgataaacagttgtcctaacaatgaacccactgtccagagtatggaggtcaaaaatgctttataaaaattagagtctgataaaaccgctttataattttccaatcctataaaatcataggaagccttgatcagatgcttggtcgtcatactgtaatataaactggaaaatatgggatatatcaacagtatccccacaaccagcagtgcaggaagtacgaaaatccagcgggcataatcaaattttacttttcttttcaccaaaatgccgcctttctgagggatgggactgcccttcgtggtggttcgggcagtccctggtaacaggttatgtattcaaaatcactgtacagtgctgaatacctcattcaatttgtcttctgctgcctgtgcagctttttccacatcagttccatttgtgataatatcctggaacatactttctatgattccctgggatgtgagaagaccggcctgaacacttgggcctttttcaaatcctatggcagtacccatatccatggtttttgtaattacatctaccgcattggaaaacttctgtacggtttcattctctttgtattccggtgtatcagatatacctgtaatggatggcagcatacccaccggtgttgcctccaggaatttgatataggtatctttctcatataatttcttgataaattccttacatatttccggatgttctgagttctcccatacaaccattggaatattggaagtttccgctccatattccgggtcatccgcatttatcttcggaagaggtgcacagtcaatctgatccactaaatcaggggagtttgtctcaacaccgccgatctggaaaccggagttaaagtcaaaggctgtctttccctgatagaacagggttgcctgatctaatactgcataatttacagaatccttcggagaacaattttcataaatgtccagccagtatcgaataccgtcaagggccagatcacttgtcagatccgctttcagatcatctgtaaggaggctcccgccgccgcttctcacatagaagttcaagaaacgtgttcccataagatcattggaaccacaggggaaggaacatccgtaaaccccgtcttttgtgagggcttttgccgcatcggcaaattcatcccatgtctttggaacttccaggcctgctgcctccagcagatcttttctgtaccacatgacctgcgcatgggaatacaatggcagggaatagcaggtaccgtccttttccccctccgacagggccgtttctgaaaacttatctcttcctatgtcgtcgatcaggtcatccaggggaacaagtgcctctgcgtccatcatctctaccacatgaccgggaagtgcagtgctcatatccggcacattcccggatgcaaggcctgtggtccatttcgtataaaaatcaccccaggaaaatgtctctatggttatatttacatccgggttatccttcataaactggtccgcggtctcctgtataacctccagacgcggcccctgtgtaaaggaatgccaaaatgtaatgtcaccttttaattctcctgtttccgctgctgtctgtttgctttctgtattcccgtcctgtccgcatcctgtaagcatagcggaacctatcatggtacccaccatcaaaattgctaattttcttttcataaagctctcctctctgttgactttttactgttctccgatatcggccgtatcgatttgtttattgtaggtttattttacctattttttttgtgtatatctactaaccaaacgctcaataatagcactagagtcttattcttattctcttgctacccttcggtactggttcggggtaaacccaaacgctgctttaaactccctgataaaataattggcatcctcatatcctacctcataggcaatatcgttgacattatcattgctcaccaaaagagccctggctgctgttgtaagccggatctccctcacatattccataggcgtttttcccatattttccttaaaaaggccgctgaacctctgcttgctcagttccgccatatttgccattttttcaggcgtatatttttctttgggatggagaacgatataatccgccacgatctgcactcttggatcgatctgtttcttcgttttcatggctctttttttaatcctctccaaatcatactcttctgttttaatttcccctttatccctgtctattttctctcctcttactgcaagggagcctatgagcagatccaggtatccccgtacaaaacatttcttcgccatatgctctgtcttcacccacctgtagatctctttgaaataattatcctctcccatactctgagtaacccttggtattccatagtattcttttaatacatcctcaccgtcataaaaaacagaggtggtaaaacggatactgaaaaattcaaatgtatcactgagcgcatggcaggacattctgcacccgctgggtatgtacacgatctgattctcttccaccagaatctcttcactgtcaatacagaactctgcctttcccttcacaatgtaacgaaaaatgttatatggtatgaccgattccggatatacccatgttcttcccatggaatatagatcaatgtagagaaatgtaaaacgtatattgtcaatcactgacatgaaggaatcccccttgtaaaatttttatgcagcttttaacaataagcaaggcagctatcagtgaagatacgcctgtcgatctgcactttatagctgccctctcttactgtctactgtacttttatcttaactaccactttttctatattttccggcttattttccatgattgccaccatgtgggcatcgctggggtaacacaccataaaatcacccggattcagcagataacgaccagacgcgctgcctttataaaaggcaatatcccgttccgcattgtaagggactgactcagtcagggacttgacatctgctgtagcgattccctctcttcctgcaacaatatagtgtaaatcaatatattttttgtgtgcttcataaatacaggcctcttccggttttgatgtaagagagacaggattgcagaaaacgcggttctcacagatcactgtatccggcaggggaagctccccctgcttcagactgtccagatagcatagtatctgatagagcatttcgtactctctgtaattttctttgttttgaatcgaatcaaagatcattgtattttcctcctgatatatcacagatcgatcttgtactggtgcagggtgttcttcaaaacgcctgccataatttcatacccctttgcattgggatgcagaccgtcataagtaatgccatccagcagcttttcagttcccggaaacgtggtggtattataatagtttacaaaaatcagcttattccttttcgctgtctgcgccagccactcattcatctctttaatgtatcttttccggatcgcttcatttagtaaaatgggtatgtgtatgggcagaagagaggtaagaattaaagtggtatccgtattttctgcctggcatatgatattgctgatattgttctgagctgttgtcaaaacctcatcatagggcttcggctccagtctcttccaataatcgccctccagttcaatggagtcattgatcccaatccccattatgcagtatctgggctttagctgcagagcatccacgtaaaaccgccttttcagaaattctgtagtgtctcctccgatgcccctgttcacgatcaactgtccgggcagattaaagtatgcatttaactcccagtaatgggtgatagaatctcctataaacagaaaatccggcttctgttccgtataaataagagaatggttcttaatgtcaaattcttttcttctgctgtccgccgccgcaatgctggaaaaatactccgatctggtatatccctcctttgttgaaatcatgcgccatccctcctcttttccaatgcacatactgctgtctgttcacagccgtctgtgacttgatatttctttaattataacaaataccttctgactccgatacggaacatgcactcaaaaatagcacaatatgcttattttgcagtgtactcaaaaaaactgccaaaaagttcctttaaagaacctttttggcagtcttccgatttccgggcacacctgttattttattttttattataacggatttacattatcctgtctatcttgccagcgattttatcttttgataggacgccaggtctatatacagatccgtcttatacggattgcgtttcgtctttttgatgtgcaggatcatatagataaatacccccgcatttgcaagaagcgcaagaagacttaccacaaaaagtgccgttgtgtttgggcttgcggaagcaagctgatagatacccggctccaccagtgctgtatatccgtccgcggccacatatccctgccggatggcagcatccgcaatggctttgctggatgtggaatgcaccatccaacggctggcatcctggaaggcaggcacggtctgggcaaacatgcaccacagcgccagcgtatgtgccctgtgctgcagccatgcgccttttcccaccgtgaatgcgcagactgtaggagccaaaagcagagcaaatccgcagtaccaggcatgtgtgggcaggcaattatatgtgtacgcaaagttccataaatcataggctacgatccagaaccacatcatgtccggccagagcatatctttgctcccgtcctttttcgtcacagcccttatgcagattccaaaccatcctgtaatagtgataatgttcaggattcctgcgatcccattcatgtagttccaggccccgccgatatagtattgtgtctggttattggtatactccataaccggcgtcacatatcttccgatctcaaaatcacgcagcacggcctcacagatattgatggccaggatcagcggcggaaaacaaagcgctatcctgttggaagacagctttttcacatgcctgatacaccagaagccgatacatcccgctgttgaggagtacacctttgccagatggaaccaatccatatacgcagtatctttaaatgccgtaagccacaaaatcgtgagcactacaggaaggatcacgaacgcagaaaaccccatccacttaaatctccgtgtcacctcattgagggcaaagagactaacaaatacccccagccacaccagcagtaccagtgctgtgggaacaccctcataaaatgcaaacatacccattccccctatttacatagaatttcttttatcatcagatcatttcccgaaaggatctccatctgctgcccttcacattttggacagcgcatatcagatctcatggcgttgaagacgctgccgcagtcccggcatttcacaatgccgggtactacacacacctccagctccgtctcttccatggaggtcttatatctggcggcaggccagcactcttccagataccttggcacaacacctgagagttcccccacctccaggacgatccgttctacctcttctgccccttcttcccgcaccacatcctcaatggtgtggatcatggcatccaggattcccagttcatgcataggatcagtcctttctgcgggtggtttttacagaggaggcagcaatttttccgcttctcttcactgcatttgccgcaatcttcactggaagcttctcatacagatccggtttggaatgacccgtgcgtttcagatgaatggcatcaaatttgcacttcgtggtacacatgccgcagcccacacacatataggaatccacctgtacagcgccgcagccgagacatctctctgtctcctttttcaactgctcctctgtaaatgtcatcctgtcatcccggaaggtacctttcttttccggcgcgtgggcagggcgctgcctgggtgtgttgtcaaagctctgcagatccaccgccacattgtttttatcaaacgcatggtattctcttctgtcacgccccaaagtcagagtctgcccgggctgtacataccggtggatggagactgccccttcctttccggctgcaattgcgtgaatggcaaacttcggtccggtgcagcagtcaccgcccacaaacacatccggttccctggtctgataggtcaggctgtctgcctgtgccgtgtttccgcgtcccagtttcaccttgcttccttccaacaggccgccccactcaatagactgaccgatagagagaagaacagcatctgccggaactgttatggtatcctgctcatcgtattttggcgcaaagcggtgcatctcatcaaagacggatacacagcgcataaattccacgcctgtcacttttccgtcctctgtcagaatccgtttcggcccccatccattctggaattccacgcagtcggcctctgcttcttctatctcctcatccagagccggcatttcctcacggctctccaggcagtacatttttacagtgtcagcaccctgtctggttgctgtccgcgccacatcaatggccacattgccgccgcccactaccactacatttccggaaagtgttcggccccggcccagattcacctcacgcaaaaattccacaccggatacaacacctagagcgtcctcaccttccacgttcagctttcgtccaccctgggcacccactgctatgtaaaatgcctcgtagccctgttttctcagttcatccagtgtcacatcttttcccacttccacgccggtcttaaattccacgcccatctctttgagcacgtcaatctctgcattcaatacctctttttccagacggaaagagggtattccaagagccagcatgccgcccagcttttcctgtttttcaaaaacagtcacctgataatcgtcgatagcaaggtaatacgcacaggaaagccccgcaggaccgccgccgatgactgctatcttatttcccagatgataacgctttttcgggacaaaacgcacatcatcatccaattccttatctgcaataaattttttgatctcatcaatggcgattggctcgtcaatatcgccgcgggtacattcatcctcacagctatggggacagatacgcccgcagaccgccgggaacggattctcttttttgatcagttccagggcttctttgtactgtcctttagcagccagcttgatatatccctgcactgcgatatgagccggacaggctgtcttacagggggaagttccctcctctgccacatcctgacggttctctctgtagtccatgttccagttctttttactccacacatgatctctggctgtgggttcctccgcttttgggatcggtgtcttagcacagagtctctggcccagcttcagggcatttgtgggacagttttccacacattgaccgcaggccacacactcctccgagttcacctctgcggtgaaattggaacggatggcatccggcgtgcggaacagggttgcaatacgcatggaaaagcaggagcagctacagcagttacagatcgccgctgattcccccagcccgtctgttgcgggcatttcatgcatcaggccattgtcttctgcgaatttcaggatttccagcacttcctcccggcttacctggcggcctcttccagtcctgatataatactctgctccggttcccatctggatgcagatatccttttccagatgaccgcagccctcacccagcacttttctggactgacggcaggaacagtcagacacgctgaacgtgtcatattttctcagataataggacagcttttcccagggctgaacgcccggaagatccttaatggcactctccacaggggttacccgcatcattgccattccttccggaaaaagaggtgccataggtgcgattctctttctggtgtactcctcaaaagccttgccgatctcaggatgcgctgcaagctgttcccggttgttaaccatcatttccaacataccaggagcaaaaatatttataaaatacctgtctctcttatcctttttatctgtccatacctttaccacacctgtgtatgtgagccggtccagaagcttcttcgtctcttccctgctcttgccgcatttttccacaatgtactcaaatgtacgcggctggcgaagccccatgaccagggcaacatctgccatatcgtctgtcaccacagcgttcagcgcgtaatactcaggggccttctcatcgatccggttcattgcccccgccacaccgccgaccatttttgccagcttcacaattttcggtcttaaatttgccatatactaacccaccctttctataccattttgcggttattatgattcttctctccaggcttttacttctgttctcagccaatctgtccaggcatccagcccttcccctgtttttgcactgatggggatcacttttgccttgggattacgcagtctgatgttctccctgcatttttccaggtcaaaatcaaagtacggcatcacatccattttattgatcaataccacatcacatacagagaacatcaggggatatttcagaggtttgtcatctccctcaggaacagacaggatcatggcattcttcacagctcctgtgtcaaactctgccggacagaccagatttcccacattttccaacacagccagatccacgttcccggttcccatggctttcagcccctgaccggtcatgtccgcgtccagatggcacataccgccggtatggagctgtatcaccttcacccccatattctctatggtacgggcatccacatccgagtcaatgtctgcctccatgatgccgatcctgagttcctttctcaaatcctcaatggtacgctgcaaagttgtggtcttgcctgaacccggggatgacatgagattcaaaagaaataccttctcttttttcagttctctgcggagttcttcagcctgcctttcattattatcaaaaatgcttcgttttacctcaatggtacggaatgcttccatttccgcatccctcctttccgcgctgtttcatactatcatcatactatgcctgaacgccttttactatagacaaaaccggcggtctgtcaaaatttttgacaaaccgccggctccgtaaaccaatctcctttatcagcatggcaggacattcctcacactacctaaaaaccatcacaattcccatgccatccttatccctctccgcaaatacctccccatccatcttcctcatgatctccctgcatatataaagcccaagcccgctcccctgctgccccatactatttgtccctctgaaaaagctctcaaatatatggttcagatcattctccgacacagcctcccccgtattaaaaatacgtatcagctgacaataatcctcctcataaaagctaaactcgatcctcctcccatccccatacttaaacgcattctccatcacattatcgatcacttccagtgccctgtccagatccccccgcacgatccggttttcatactttcctatcaccagttccaccatccgcaccgcacacttttctacataagtgtccgccacccgccttaccagttcttccagataaaattctcccatttctacccggatatccagtatatcctcttttgagttcctcacgatctccgccacatacccctcaatctcttctgccttcacaccgatctgacgggccgcgtgtcgtttcttctcctctgtatcgtagagtccctgttccagtgctttcccatagagcttaatggtcccaagaggcgtcttcatatcatgggacagggacaacagcatttttttcttttccctttccagctcaagcctccgcttttttgtcacctccagcgtatcctttaactgcccgatgccccataaaaaatttccgaaatacctgtttttctcctgcttcacttcccctttcagatgcccttttgccagctcataaggcagctcactcacccggttgaacggcttgatcacccggtatttgagatataaaagcacccctgtcactgagactgccataagcgcaagtgcagcctgcacggtcatcatcacaccgtccaggctcatatattcctctctatataaaaaacggagataccctttcagactgccgtctgcgatccagggcttcacaacaacatttccgtcatttacatctttaaaaaacatttccacgctctcccggctttcggcttcatccagggtcaggacttctatcccgtacacgtccctgtatctgcccagatccacttgaccgggatgtgttcccactgatatctcatgacagatccggttgatctccactttgaattctctgtctctttccccctgcatccggtaaagtaccatacccgttcccagtgccagaaggagatagagacttataaacactgccaatatcctgttatatttcctcataccggtaccccacaccccagaccgtctgaatgcgctcaggctttctgggatcctcctcaattttgcttctcagcattttgatatggaccgtcaaagtctgattttcactaaagctttcccttccccatatacggtcaaacagatactctttatgaagggttctccccggattctcagccaacaaaagcagcagttcatactccttcgcattcaactctaccgcccggccttcccggtaaaccttccgtgaatttctgtctatggtaagactgccggataccaggtaatcggtctcagtcctggccccataggtcctctgtatcagcgctcttactttagcggtcagcagatccgggtccacaggcttttccatatagtcatccgcccccagctcaaatccgttcaacttatcatcctttcccgccctggcactcatgatcaatatggggatattccccttctcacgcactgcccggcagacggcaaagccgtccatgccgggaagcataatatccagaagcagtatcttcacacaattctcctccaggtaagcagacgcctcctccccggtggaaacagaagaaacagaaaacccatccttttctaaaaatgcctgcagaagctctgccagctccctgttgtcttccaccagcaaaatatctttcatacaaatcctctctttaccatccgagcttgatcagccagtcgttcaatgtgcgctccctggctctaagatcccggtcttcctgccattttccaagtgtgatatcctcccggatatcaccatcctcaatatacaaaactctctcacagcgggccgctactttcatatcatgggtgaccagaagaatactggtaccctcccggttaatacggttcaactcctccatgacctcaatggaattctgtttgttaagcgctcccgtaggttcatccgcgaatatgatcttcggctcgttgatcaggctgcggcagatacatgccctctgaagctgtccgccggacacctcattgatatcattgtccgccacttcactgattcccagcttctgcatcagtatctttgccctctcattgactgctgcccggcctgccttggtcttgcccacggctgtctggtaagcaggcataataatgttatcatagattgacagatttttcagcatatacatctgctgaaatacaaatcccatctgttccagcctcatatcactgatctcattggcattcagctttgtcagctcacgcccaaagaaatccacttttcccgcagtggcattgtccatgccgctgaccgtgtaaagaagagttgttttgcccgaaccggaaggccccataacagccaccatctccccttcttttatctccagatttacattcctcagtacattattctggcgcttatctataacatatgttttgcataaattagaaactctcaatgactccattttcctctacctccatccaaacctctactctatattgttcatttcacgtatatggatctgcttcactttcctggttgcaaaaatggtggctgcaatgatccccaccaacagtattcccggataaacgccgtatacctgccagggcacgacctggatctcaacactggctcccatgatggcaaagatcggtttcagcacaaactgattgctcagaagagacaggggtaccgctgcgatcatggataccagaaccacccaaaccatgcgtagaatctgccatttacggatactcctgtttctgaaccccacacttttcatcatggcgatctcccctttttccctcacgataaagagtttttccatgagtgcagtgatcagcatgatgatggcgcagagcaggcccgtcattgggagaagaaggtctgataaggaatcctggatgccgcccacattctgatccaccagagcctgtgcatcggcccattcatagccgggaaacttctcctggagttcttttgccagctccttctgtgtcttatctgtatccatatccaccagaatattccagtaatccgccaacatttcatccttcatatcaatgaccggattcagcctgcctgactgtcctaactgcatgtaatcagagtatgtgcctgttatgatgaatgttttgtttttactgccgatccttacatctacccagtcaccaatgttccatttattctgcttcaaaaccgtttctgagagtgcgatctcgttttccagccttggggcctcacccttgtcataaatcagataatcgttgtcctgacccagattctgtaataccaaaagcttttgatctgaggccgttccatcctttgaaactttcaaaaagtaaaagggaattcccgtgagtttagcatcgtatccctcttccttcatctcctgttccacacgctgcattccctttaacaggtcctctttatttctgtaattcccctcacttggctgctctatccttctcacatataccgcgctgtgtgggttcagggcaaatttaactaccatctcactgctcctcatggtgttgatggtgttcagcggaatggtgatcagcacaaagctgatacagaacgtgatcatgagtaccagataccgccgcatatgggtgagcatatcgttcagtcccaggaacatgggaacagacattttccctctccggttcagtctgatcccggcccgcctgccgtatctctcccctgactttccgcctcggacagcagcgatcgccgatatcttatccagctttccggtacagatataacagaaaagcatgaccagaaagatgatgcacccagaacaaatgaggtttacccacagattggaaccgctgtcctccatgatcatatttcggctgacacttttcaccatggcccggctgaccgggacactaactgtaaagcccaccacagtacctgctgacacgagaaccagatactttacgagatacactttttttactacaaaattccgaaatcccacagccttcatgatcccgatctcccggtattcctcctccatggtaaacaccagtgtaaagcggagtaccagaagtgcaataagaatcaggcagatacctaccaggatcaaaagggcagccatgatcatatcgaaggaatagatcatgtcgtatgtgccctttgtgacagtacttaaaacagttgtaaaatcctgttcattcagcgccctcacaaactctgtctcatgatctgtcatgaccagatacatactgatatcttctgcatgttcgtctttatggaatgtatgataatcctctttgcttaaaatgatacggttcattccggtcatgtcatttccaaaagccgcgtccttcatctgctgggcaaccgtcagttctttttctgtatctcccacggaaatgacaattttatctcccgtcttcagatgatttctctccatggcatccctggtcatggcagcctgcccggccttcagggaaaaagactttccgtccgggtcaaagaccttgcagtattccatccccacagcgcttatatacacagaggttcctgcggtatcgtactcctttttctttccgttttttataatttttatatcctggtcattgagggcgatcaggctgctctttccatattcctttatgtccccatactgactgtccagccatttttccaccttttcattctctgtttctccccgcatgataaaattcacaccggggatttttgagtagcttgtgtaatgatcaatggctgaactcacaaccaggatattgttcacgctgctggccagaaaaatggttgcaatggtgataaacagaaacagtatcacattgactccctttctcctcagcaaatccttctttaatattctgtaaaacatttggctatccttccctttcctgttttctgagttgattataacccggcaattatgaaaaaatccttaaatcggattccttttatttacacacagaaaactttccggattatcctatacaaatctactgttataaagtataatcataccagacagtcaaaacatttttcaaacaataaaagggggcatttttttatgaaacgatatgttatattcgcgtagcagaggctattgcgaattatgataccatatagaatagcctttgcgaatcctggaactaaaataaccgaggaggacaggatgagctacaaaaaggctgataagatccttccaaaagaattgttggaactgatacagcagtacgtggagggtgagagcatctatattcccaggaggacagaaaatagacgttcctggggagacggcacgggcatccggcaggaaatcgcagcgcgcaatgccatgctgtaccgtgattaccgaaacggcgcagacccagcgggactggcagataaatactgcctgtctttgaaaagcgtacagcggatcttattacaggaaaaaaggaaataggtaataatagaaatataaaaggacagcataacctgcaggaatgcgttatgctgttcttttttgtttacactccgtaactgttcagtgccttcacagtcacagacaaaagttcggagagaattgactgcagcagtgggatttttcctcattctcttttagaaaaaagtttaaggtggataccgccgtcacctcccgctataatatccccatacctaaaaaggaggaacccatcatgctggaacccaagaaaaatgcatagcagaggctattgcattataacaattctatagtgaaatagcctttgcagatcctgaaccgataaaaatcgaaaggaatatgcatatgagctatttaaaggaggagacatggaccattacacctgtctcttcgtataaaatcatcagaaactgtccaaaatgcggcacaaaatctctctttcaaagtaccggggatttccgcatcaatgccaatggaaaatgtattgatatctggctgatctatcagtgtgaaaagtgcaggtccacctataatctgacagtttttgaacgtatcagccccaaaaaactgccgcaggaattatatgaaaaattccaggaaaatgacagcagtcttgcactggagatcggaacagacagagaagtttttgagaaaaacagagctgttgtgaaggaagaatctgtctcatatatggtagataaaaaagatacagaaacacccgtttctttacaaatatcggatgaaaaccactgtatcatctgcataagaaatcctcacagcctgaaaatccgggccgataaatttctggcagagcagctttccatctcccggtcaaagataaaacgcctgatcacagacggggtattacagggaagtaataacgagaatctggaaaaaatccatatcaccaatggcttgatcatccttctcaaaacggatgtttgagcagatacctaaaaacggcagggaaagccttatactttgctttccctgccgtgatccatatttttttatcctgcgatatctgctgcaggggaactgtccccctttattttctctatggtccatcctgtctgtgcacatatcagggacacaatgggattgatcaaattcagaaaacaaaatggtgcgtagatacctgttgtcactcccagaacgcctgacaggaaagcggcatctgtcccccacggaacaaaaggagcacacagcgttccggtatcctccaaagctcttgaaagattctttggatgcagtccccgctctctgtatatatctttgaacatcctgcccggaatgatcagtgccacatactgcacacctgtggcgaaattggtaaagatcgtagacaaaagggttgctgttatgactgtggaatctttcttcgcattccttagggcacgctctatgactgtgttcaccatgccgcttttctccacgatccctgcaaaggaaagtgagatcaggatcaggcagataatctccatcatactagtcatgccgcccctgttaagcagtttatccacctccgacactcctgtctcaatagaaaatccggagaaagcggaggtgatcacagactgcagttcagccctctggaaagccagtgcaaacacacatcccagtaatgccactgcgatgagccccggcagggccggtatctttttgatcaccatgacgatgaccagcacaggcggtatcagcataataggagagatatagaaaatgtctttcagcgtagatgtatacagctctaccagggaggagtcaaaattatttcctgcaaatttaatgccgataataccatatatgataagcgctataataaaactgggccctgttgtatagatcatatgtcttatgtgtgtaaagatatctgttccggccatagctggtgccagattagtcgtgtctgacagaggggacattttatcaccaaagtatgcgcctgatatgatggcacctgctgtcatacccgccggaactcccagcccgctgccgattcccatgagtgccacaccgatagtccccactgtggaccaggaacttccggtagctgtagcgatcactgcacagatcagacagcttgccagcagaaataccgacggggacaagattttaagcccataataaatcatggtgggcacaatgccgcccagcagccagacgccgatgatcacaccgatcgccagcaggatcaggattgccggcacggctgccttgatggtgtcaccgatcccatcctgcagttcattccaggaataaccggaacccacagccacaattccggccacaatggctgcgatgagcattgccacatgagccggccctccaagaccaacagtcactgtgagaagcgcagcaactacaaatgcgaatacaaacactgattttgtaaatgtcatatttttctgccgttcttttttttccgccgctcataatcttccgtctcctttttccgcttctctctctatcatctctgctgtatcaaagacgattccttttaccgctctttctttgtaccgtttttccgcctctgttatctttaatttggattctctggccctgcttgtccgaatggactttattttctgagacagccattgggcagcttcctcttttttctcctcggacttcccgcccagcagacaggcacattcaaactccaccggtcttacatccactgcccctatgaagcccttcatatccgtgtatccattatccccctctttccaggatatgcatagggaaatctgggcaatggtcacttctcttctgctccccagtttggcaaaacagctcttttgcccctcctccacaggaagccagatggatgtgagaagttcatttctgccaagaactgtgcgtccgttttctgtaagaaattttttcgcttccacatagcggagtccatctttccctaaaatctctaacttccctccatacaggaaaacgcatggcataatatcacccgccggtgaagcgttcgccaggcttccccccagtgtccccttgttgcgtatctgctgggaccctacccggctgcaggccatggcaagccctgtaaaatattctctgacaagagggttttccgctgcctgtccatgggttgccatcgccccgatcttcagccaatccccctgtctttctatgtttccgagcgtttctaactgacacaggcttaaataaatatccggttccttttttcctgaccggatcttcggaagcaaatctgtacctccggccagaataacggatctgtccgtcagcctctctaattccctctccagttcctcccagctcttcggctgcaaatattctgtgctcatgtggcacctcccatttcgctttcggctgcctcctgtatggcatcctttatttcccggtacccggaacatctgcagatattaccggcaattgcccgctttatctcctcctgggtaggagttggattatgaaggaggagtgcttttgctgacatcaccattccgctagtgcagaatccgcactggatggcgctttttttgataaatgctttctggattgcatccatctccccgttcttttccagcccttcaatggtgagcagttcactgtcctccaactgccctgcaactgtgaggcaggagtggatggcctgtccgtttaaaatcacggtgcaggctccgcactctccttccccgcagccttcctttgtccccgtcagatgcaggtcttctctgataaaatccaaaagccgtttttctcccggaacctccatagttttctcttccccgtttaatataaaatgcaatatcatacgcttctttcctccaatgcttccaaaatgaccgccggggtcagggggagcctagtcagattagtccccagtgcgtcgttgactcccgctactatagccggcgccacaggcaccaccaccacttcccctatggatttcgccccaaacggaccgctgttctcaggttcctcgatcagcagagtctgataatccggcaggtcacaggcattggccacctcatagtttttaaagttcgttatgagtgtctgcccggtcttcggatgtattttgatctcctcacaaagtgccattcccattccctgctgtatgccgcttccaatctgccccttgcagagatcaggattgatggctttgccaatatcatgtacggagagacagtccatgatttttgtcatgccggtataggtatccacccttacctcggtaaaatgagcggcggccacacccggattttctccggcattggtggtgtttgcatagtagatatcctgtcccatggtctgtatggaataccggatgacctccttcagggatatcctcaccgcctcatccatctccttaaaaaattctcctgaccggtagcggagaaaactcctgctgcatccaagggctgccgctgccgtctctcttgccatttccagaatgtgttcgcagcactgtttgacagactgtcccagggaatacacagtcctgctggcatagcagccataatcatagagactattctgggtatccgcctcgttcagctcaattttatccaggctgatctccataatctccgacgcaatctttttcattgccatgactgttccgcagccatggtcatgtattcccacgtggatgatcaggctgccgtcctcctggattctggcggctgtggaggagacatccaccctataggggtaaaaggaactggtatgggaggccagcgccatgcccactccatagcggtatctcctctgctccctgtttctctttctgcacgcttctttccttttttcccatccaaaagtctcccggcccttcagcaggcattccctgaaatgtacatttcccactggaatcttatgtactacctccgtctcatagggatacaggatatttttcagcctaaactccacaggatctatccccatctccctgcacaccatattccagtggttctccaaaagcaaagcctcctcacaagaaccccagctccgaaaacttccgttgatgggggtgttggtacagaccacccggctgtcaaaatgtatattgggcatacggtacacttttgctattttttctccgatagtggaggcataccccctggatacggtgagataagctcctgcgtccagtgtacaggacatggaaagccccgctatggttccgtccttccggatcttgctcttcaccgttccgtctagactgtgtttcatcatggtattcacgatctgctcttctcttgtataaaccagatttacatctgcctccagcattctggccgcatatgcggtcaatggctccagcagtgtctcctgtctgacgccgaaggaacctcccataggggcttttatgacccggaccctggcgtaaggcattcccaggtattccgcaactgtgctcctgacaccaaacacagactgacagcctgaccatatggtgagcttttgggaggcggcgtcataagctgctctgcaggactgggtctccatggccagatgtgtcattcttcctatatgagacctgctttcatgaaaaaaatctcccccggcttcctcaaagttcccgtattcaaacgacggaacctcgtaaacattgccgtctgcatgcaggggcaatgcctccggcgctgccgcctcctccactgatatggctgcgggaagattttcatactcaactgtgatcagttcacacgcttttgccgcagtctcctctgtgactgccacaaccgcagccaccctttcccccagaaaacggatatgcctgtcaaacagcttttcctggttgggaacattttcccatgcctccactctgcccctgtcataacaggtgcccggtgtgttttcacaggaatacactgctaccacccccggaagtgccagcgcttcgtctgtatttatgcggcggatgatcccatggggaatggtgcctgctttcagccgcatatgcagcatatccaaagactgcatatcactacaatatttgacccgcccggtcactttgccgtatgcctggtcatttgacagttcctttcctatcactttgtaattttccattttttcaccatccattacctctcggattttatttgttccagcatataggaaaatcatcaaaaaaatatcaaaaaagaagtgtcaaaaaaattaattttcattgtaatcttttgacactgaatttataataataatcataactgttcagtacccttacagttatgagcaaaaatccatgcaaatcgcctttggcgatgggatttttgcctggctgctgaatgttttcttacggtcagcgcagtaaatgcgcagacctactgaatagttactaataatcaatactataacaaagccttatatcaggaggtatcttatgagtcagcaattggcagtatcaatgctgggaaacccatccatcctgctggacgggtcaccccttgtttttccctatcggcaggcagaggccatactgtattacctttttctgaacaaagcagggaataaatatacgctggctgacctcatatgggaagataaatgtacggaggagaagacaaattcaaaccttagaaatgccttttatatcatccgtaagaatctaggaaaggatttcctggtaaaagaatccggagatatcattaagatcaatcccgccttctccctgactattgacacagactgttttttgaaaaacggggatgatctgtcgctgtacagaggtgattttctggagggattttatctgaaaaataatatatcctttaatgaatgggttactaataaccgccaggtttttaaagcgcattacttaaaaaaactacactgcgccatctcccatcactttgattccgggaattatgaactctgtgagtccctctgccagaaacagatgttgatcaatgaatttgatgagactgcctacaaatatctgatgcagatctacctttccagaaaagaatatacacaggccctgcacatctataaccgtctggaatccctgctggaacaggaacttttcgagacacccgcaaaagatatacaggacctggcttttgtcattgagcagacctggaacgaggaagtgaataagattctggagggccgaaaggaattgaaatctcaggaacgcgtctcctctgtcttctgcggaagagaagctgagctggagcgcatagaaaagaatctttcctctcttggacaaagtgtaccggtacagcacctgctgctcataggggaagccggagttggcaagacacggcttgcgaaacaggcactttccgctcaacccctgcctgcagattctcttttactaacttcccgctgctattgcgcggaagagaaatacatattaaaaccctggcagaagcctgcccgggaacttttgcagtacctggcagacacagaaaatacagcgcagcatatttctctagtgcagagtatacaggccctgttccccttcactcaggaacagtgccatcccatgccggacgcggatgatatctccacactggattacaaaagcattcagagtatctttgtcaatggcctgatccgtctgtcctccagtgtacctctgatcttcttttttgatgatatacaatgggcagacaaggtgagcctgtcactcatgcgcgacattatcaccagtctgaaagattacagccggcagaatctcttttttcttttcactgcccgcagcagcttggaaggggatgctgaacgtttttcggaggatatgtgttccatcggacaattagaacacattacagtgaaccgttttgattatggtgataccatattccttgcctcccgtctccttcccggttatgtctttacagacaatgtaaaggaacagctattccacgaaacggaaggcaatgcactttttatcacggaagctgtcaatacaataaagtaccatggctctcccgatgatatcactcccaatatgcgcaatattattaagcagcgcatagctcctattcctgcggaataccgccagatcatgaatctggtgtctatattttttgacggagtatcttatgactgtctctccgttctttcccggaaagaggattttgaactggtagaaatccttgaataccttctggacaaggatttgctaaaagaagatgcggaccaggaaaatacctttttttccttctcccatcaaaaaatcctggagtatgtgtacgacgaaatgtcctggacgaaaaagaggatcctccacaataaagcgggccattattttgagagccgcctctgcgcaggccctgctgatatggcactgtatcccaaactgatctttcattttgaaaggggcgccaacaggcagaaatatctgaaatatgctgtgaaatacctatataattacctgaatgtcacccatgaattttttcctattatcggacataatctgactctgtttaccctggatatgagggaggagacaagtgaccggctgtccgctgacctgagcagcatcgaagaacttctttatgctgtggaaaataaagtaaatgaatcctcttttgaactctttgacggggagaattccggggaagaacagctggaaatactgtcggattatctgcacatgatagggcgtcattatatacggatatgcagctatgagaaaggtcttttttatattttaaagttaaaagaactgaatcagaaaaccccttccacttttcggctcactaagcttctgcaggcaaaccgccagttgatctgtgtatatatcaaccgctatgaacctgataaaatggaagaggttgtatcggaatccctgcagcttctctcacctacggatttctctgatgagacagcaatctggaagcggctgcagggtctcggtgatatcatgaaaggcagtctggaaaagggaatttcccatctgcaggatgccattgaaattttcagcagttcccccgccagagacgagcatctatacaatctggccgctgcctattcctggatcggagaggcattccggcattccatggcatacgaaaaggcaatggaatgctatgaaaaggctctgcagatcggcggcagcaacttcctggtcagcggggtatcggtattctacgcctatgcgggaatggcctcttatgacagcggcagcctttgttctgcggaaaaatatctgacagagtccattgcccgctacgagcagggaaatcttatgtggggacgcagtcttccatattcctactattcccagatactcctggaaaaaggagaatgggataaggcactgaaccatctggaaactgcgctgggttatgcagaaaagctgcaaaatccttatgaaaagggagttatataccgcatctacgcacagataaaagcgggagtctatccggcaggcgagaacaacatttccgttcagaatgcgcttccctctgacgctgcatattattaccatgaggcgcgccgcatgctccgggatgtctactctccggtggatgaacaatatctggatgctgtcgaaaaaatagtgtctgagctttaatgaaaacttaaagctgttccggcttttaacagtcggaaaacctgttctgccgtatctgccatattctccctggcatttaatggtttcatggcctcatccagtgtgcataccccccgcaggatagggaagaaggcatcaatccctttttcattacaggcaatggcgtcccttgtcacgcttcccgcaaacgcaatgactggttttccatgctttttcgcaagctctgccacacctacaggggcttttcccatagccgtctggccatccagcctgccttccccggtgatgaccaggtcggcctcttttatatagtcctccagtccggtctcctccagaacgattttgatcccggactccaaaacagcgttggtaaatgtgagaaaagcaaatccaagccccccggcagcccctgtgcccggctgcatgggatcagcttttgggaagctcttctgtgccagtgaggcgtaccgctccagccactcatccatctgaacgatcatagacggtgtggcacctttctgcggaccgtaaacggcactgcatccctgctccccgcacagcacattcgtcacatcacaggcaactctgaactggcattcttcaagtccgggtacaacatgatctgcagtgaccgataccagttcagaaagcccctctgccccgtatttgacctgttctcccgccgcgttcagaaaaccgtatcccagtgcctgcagcataccgataccgccgtcattggtggcgcttcctcctatccccacaataaatcttctacagcctttttctatggcatcccttatcacctcacccacaccatacgttgtggtgtgaaggggatttctctccccgggtgtaagcagtgtgatgcccgccgcacctgacatctcaacaatagctgtctctgtgtcctcaatgataccatattcacatgttaccggctttccgagaggacctgtgaccgtgacgcgctgtatctttccgtccatgcctcctgccagcgcttccacagtgccctcacctccatctgccagcggccggacgttcactttcgccccgggaaatacccgtaaaatcccttcccgggcagcactgcctgcctctatggacgacagacttcccttcaatgaatcaatagctgtgactactctcatattcttatcctccgataattcttttttctaatataacaaaaaatgaattttcctgatatgttatatgtaatattttttttaataatttttataattttatagtatatatactaataatctgttatactttatcaaaacgtgatgtttcttgcaatgtattactcaatgtaccactaaatgtatcactcaatgcatcactcaatgcatcactcaatttaccactaaatgtaccactcaatgcatcattcaaaatatcactcaacgcttcactatacagggggaatcagttatggagaatcctattgataaaaaattggcacagcagattgtagacacggtaaaagatgtgtgtggacaaaatgtaaatttcattgatcatataggcatcatctatgccagcacagatgaaaaaagaatcggaagttttcatgaaatcggaaagcaggccgcagaaaaaggagagatgatggaagtggatactgacagcctgtttgccggaacccagaagggggtcaacctgccggtctttcacaacggttcctttgtggctgtcataggcatcagcggccccccggaccaggtgcgcaaatacgcctatctggctgaacgcatcaccggtcttctgatccgggaacgggagcttaacaccttcagtcgcacccaggcggagaaaatgcactatgtgatccattccctcatcaatcgagagaacctttccaaggcttaccttctggatctgctggaacatttcaggatcagcaggcatggcagataccggcttcttttgatccatatccgctccgacaggtcacctatgaatacctcggaagcagaacaaaagatccaacagatgttttcccgcacaggtattacactcttcaccttcaactatcccagtgaatatctggctgtactggacaacagcaggtttcctgccatctcccccctattggaacaattttctgtctcccagaacggaaagctgaaaatggccgtgggaaaaagctgtcctgtctttcagttgtcggattcctgcagtacgggagccgccgcgctgaaaagcatcgcctcctccgctgcccggcattatgctgtctttgacgaccttaccctggagctgatactcgcctccgtagatgaaggatgtcggacagaatatctccacaaaaccctggattcgctggatggagaggacatatctcttctttctgcctactttgaggaggacatgtccctggggcacaccagcagcaggctgtttcttcacaagaatacactccagtacaaactggaccgcatttacaaaaaatgcggactgaaccccagaaaattccgggacgcagcagtgctttatctggcactgaagctcacctgatctcctgcggatactcgcccttttgcgcattttattaacggaagagcctccgtaagggaatggatcacagtaaccccctcacaggatttatccccctgtctgtccagcagcacaggggtgattcccgccctgacagctcccgcaacatcagaggtgacagagtccccgatgtggatgacttcctccgcattcagaccgctgacctccagcgcttttaaaaagatttcctcatggggtttgtaagccctcaccatatctccgcagataatacccgccgggtgcagatccttgtcccgcatgccttcctccacataggaaagcccattgttgctgataacaaagatgggaacgctgcatttgtcaaagaattcctttgtgtcgggaaatgctggggcatacatccagaaacgctgacagagcctgtgaagctccgcgaaattttctttcaaatggatcttctctgcgcactccgccagtgccctgtccacgatctcatcttctgtgatataactttctttataactgacaacttcataagctttgatcagtttccaccagtaggccagcattgcctccatactctctatatcactgtttttccagcaccgcttcagcatctccatgccgtccggtccgccctcttcaataatagtacctgtataatctaaaaatactgctttgatcatctatttactccctgtctttttaaattctgcctgacttctgaatcattaccatgtattctcatttctactcaaagaaaaactttgttttcttttctgccgctgcaggtctttttcatttttaccgaggccgccctcagcatgatctggtttacatttcttgccttctggggacaaacagtaatgcagcgcatacaggagatacatttttccttgtccacctccgacgggttctgcgccggtattgcccccaccgggcattttgccgcacagaccccgcatttgctacagcgttttccggctttcggcttcagaggaatgccgctgtaatttctatagggtttatttcccggtacctttactttctctcctctgttatgcctctccagcttctcttttattcttttggaaaactcccccagctctgccctgtccttttcatccggtcttccggctccgaactgcctcataacagaatgttcagccacggccgctgctgctgccgtacagtgaaatcctgcatctgtgagagcttcctcaagctccagcagtgtgtcatcatactccctgtttccgtatactgccacagggacagcctgcgctcccccacctttcatctgtctgaccgcatccagggccgccttaggcacccttcccccgaaagacggaactcccacaacgcagatatcctccttatcaaaaacatacctggtataatccccctgaaaaacagacagatcgatctcctgcttttcttcctcccaggctctgcacagtatatctgtcaccgttttcgttccccctgtggggctgaaataaatatcatataatttcattttctgtcctttccttcaccttcgccagacatacatccatcatttcctccgcgtctctccacagctctgccaccagtttcaggctgctgctggccggatcaagataatagaaattcatggttccccgcctgctgaccgtaatgatcccggcttccatcaatatcttcaaatgatgggataccgcagtgcgggatatattggtgttcctctgaatctgccccacacgcagtccgccctccccgcagtgctcaatcagggttcggatgatatgctgcctggtctcatctccaaccgcagagagcgcaggctgacaaagcacaaatttttccgcaaaaagtttcctgcgttcctccagcgtgattccttccatgctcttcctccaatggtcaatatttatcgactattatagaatagattggcccccacttcaacattggtaaagaaaatcaggttcattaaatcaaaaagaccgctgcacagtccgtctgaaaactgtgcagcggttctaaaaaaatcaatggcatttgctccatccgcagctcttacagatattgcatccctcctcaaagacgagggcctccccgcattcgggacagtatatcttgtccgtctccggtccggtcacagccttggctttcggggccttcttctgagaccgcccgcccaagtctttttccttccgggtaagttctgcctgcatttcgttatacatatccatcagggcatttcccactgccatcgggcagcatgcccctttgctggtatcctttctggtcacgcggcgcgctgtgtaggaaggacaggaaccgctggaattgagctgatccacaatggtctcaatatcaatcccgcctctggcactgatggagatcatacgggacagccccaccatgaaattgttacagcctcctgtagaacccttgctcagataggtttccagcagcgcaccggtatggggatcaaagagcgcgatacagtgaaggcttccgcatccggtgatgagcttgcgcttcttgcccaccacgtcgtctgtgacaagaatgatgtccccgcgcttcagtccttctcctgccgccaccttttttgtctccttggtattcagtatcccggtcctcttacagccgtcacggaaaatggtgatcccctttaatccgctctcataagcgtacagatacagactctctgtctcctccacggtaaaactgttcggcacattcactgtggagctgatagatgcgtcgatatgcttctgccatacagactgcatatcaatcctctggcggtaatccagtgtcatggctgtgacaaagtattccggcagggatttgtcatcctttatctcaaactgtttcatatagttttccacgatctttgtatacaccttgtaatatacatcggttccatgcagggattccgtcttccgctcatagtaattggcatacaccggttcaatccccccggaaatccccagcatggtagacagggttcccgttggcgcgatcgtcagaagctgtgaattgcgcataccgtatttgctgacaagtccccttgtcttttccgtagtatttgctgtaaaatatggagtctccatgatctcttccacacagcaggcaggaaaggcacctttctccctggcaagctttgcggaggcggcaatggctgcatccgccatggcaaatcctatcttatcgcacatttccacagcctcagcctctccgtaggtgatgcccagcttgatcagggcatccgccagtcccatgataccaagcccgatctgacgccatttttccacactttttctctgctcctccagcggatgcaggggcagtccctcttccaggacctcattcagtgcgtttacagacgcctgcacgcacttcttaaagctgtcaaaatcaaaaaacgcagtatctgtaaacggattctgtacgaactccgccaggttcacacttcccagcagacagcttccccctgccggcagcggctcctctgcgcatggatttacgcctgcataggcaaagtcctctgtattgctcaacaggttccagcctgtaatgcggtcccagaacaaagctcccggctccgcgtaatcccagtttgtctccgcgatccttctgaacagttctctggcattcactgtcttttcgataacctcccctgtaacttcacgagtgtagtgcagaagatagtccttattttcctttaccgcttccataaaatcctcatggatacggatggaaatattggcctttgtcaccttgtccaggtctgtcttaagattaataaattcctgcacatccgggtgggaacagtcaatagagatcatcagcgcgccccgccttccgttctgcccgatcagggaagtaacaagagaatacagctccataaaggacacggagccgctggtctctttggccgcattgtttatttttgcccctctgggactcaattttgatatatcaatgccgcatcctccgccatagctgtaggtacgcgccaattttcttgcacagtcaaaaatactctcaatctcatcctcaggtggttcaatgacgtaacaattggaatatgtcacctttctgttctgcttctgaagtcctctgtttgagagaatccttccgccaaacaaaaattttctctgtctgatatactctttgatctcttcatttcccccacttatccttgtaagccaggcctcgaaatcctcgtcttcacagcagtatttctttgcccagatatccataccaagctggttctcctcacccagccactcttctattgtcatatgatcgctccttatccagatttagtcaacgatttttatattaccacaatatatggggtaaatcaaggtgtgaaactgaagattttgcatctatggtgtattcccgcaacaattcaaacaggactgcgcacaaactttttgtttatgcgcagtccctgttgtcttctattccacacagtcgttctgcacggtgggaaaagaagacgcggatcctctgtaatttttcggactgataccatatctctgtttaaatatcttggagaaggtcaggggattttcataccccacctcagccgcgatctgattgatgggaaactctgtattcttcagcatggtcactgctttctccatgcgcagattaacaagaaactgctgaggggagcagcctatcattttcttaaaactctttgccagatagcttctgttgatgcctatccgctctgccagatcattgactttgacttttctgttataattctccgccagaaattcctttgcatagtttacgtaggccgccgcggaataagaatatgtgtcctggtttttatgcagcacctggtattcttcgatcagttcagagagaaaccactgcatcatgctgtttctcctcaactcatttaccagggtgagctgaggtatctccagcatttttcggatgatcccgtggagacgctctgcacatgccacctgcctgactaaccgctgctgcccaaatcctgccttagccagacattcataggctttcaggccggaaaaaccgatccacatataaacccacggctcctcctgatctgcccggtagctgcctttcctgtacggcggaattaaaaatgcgtcattttctcccagatgaaaggtctggtcatcaatctccagtattccctttcctctcaaaataatatgaatgaggtagatagaacgcttcgggggactatggaaataacccggtcggcactcctcaatcccgcagtaattcagcgccagctccacggagtcctggctttcattgtctaaaaaagctttgagtctcagattcatccccggatcatgttccatttttcctcctgtctatctgtccatccaccatttcaacacatcccggatctgctcatcccagcagtcccaggtatggcttccctcagactcctttacagtcacttcaattcccagttctttcatgtgctcccatgtatgtagattgtcctcataaagaaagtcctgcctgccgcaccacgcatagagtcttggcatttctttttccgaagcttttctctcggcagccagctcccacaggtcattgtcagaacctctgacagactccccgcttccgaaaatgccgttccagaatgcctgctcctccggttcctcctgtctgtgcctttccagactggccgcaaggtctaaagcccccgacagagctgcccccgcgccaaaattttcactgccgtcaagggccgctttccatgcgccgtatccgcccattgacacccctgccgccagaatatcctctttcctatcagagatattggggaagaactcccggcagatgcccggaagctctctgcacaggaaggtctggtaacgcataccgtactttgtgtccgtataccaccccaattgaacttccggcatgatcactgcgatccccagttcactgacgtagcgttcaatggaggtccgccggcaccatgtggtatggtcatctgtcataccgtgcagcagaaacactgccgggtatttccctttcctcaccgtgcctatcataccaatctgacggctggtcctctggggaaggatcacggacatctgtgtgcacattcccagcacttcagagaaaaaatcaacttgaagtaaagccatacatcctacctctttccatacttattcttccgccaaagactggtccataaactctgcgatctctctgcaggcatccgccatagacttgtctccggcgtaaacctcctttaaaatctcatttgctttgttctcccaggtgacagtggtcttggaatagggacggatcaccatgtcatccatcatattcagataagcctttaggttaaaatcagcggaattggcccatgcgtctgaggtatccttataagcggacattgtaattcccagttctgcctgtttgatctgggcttcctttgaacctaaatactctatcagcttccatgcatcctctgtgtgttccccatttgccgctgccgcccagcccagtccgttgtagacagacattctttttcctgtctccgcgttcatgggaagctccacacagtcgcagttctccgctgtatattcattttctttgaaataagccagcatccaggacccctggaaggtcatggcaattttcccggattggaacaatacgtcctcaccgttttccgacatagtttccagtgtgggcataactcctgcctggatccagctctccagcatttccatggcctggattgtcttgggatcatcccaccctgactttttcttatcctccgagataatataaccgccattgtcatagatcatattgtagtagcccgcctggttgttgtcattgcgcatggcaagaccgtactggctgccatcctcttttgtgagctttttggctgcctcaaacacatcattccaggtccactctgctgtgggatactctacgcccgcctcgtcaaacatcttcttattataccacagggcaatggtgtccacatcctttggcactgcgtactgtttgttgtcattgttatataattttacaatatcctcggggtaattggcaaggtcaatcctgtcactgctctcgatcttatctgtcagatccagaagcagtccgttggtcatatagcgttccgcttcattggaatgcatccagaatacatcagggagtgtaccgcccctggctcccgcatccagcatagtccagtattcatcccatttgaccacgcctgtctccgccttgatccccgtctccttggtaaaatcatcaaggatcttctgcaggccttttgcctgattgtcatcccatgtcatgacagacagtaccccgtcactttttttctctgacccgctgctttccttctcctgcccgtccgcgttctgtccgcaggctgccaatactgccgctgctgccgatgccagtaaaatggcactcattctttttaatctcataccttatctcctttttttgctgtgaacttactgctgtaaacttacaggtgttccggaaccctctgtttgttttattataagaaatccgaagcagcgataaaatagagtaatgtatgagactcataacctaatgtgtctttttcttttcatttttctatattactcggtgtaattgatccttgttaccagggaatccctgttctgcgatctcagacagatatatgtgatcagcattggtacaaacagcatgcacagaacatagatcccgtattccgccaaaggaaattgaaagtgcatatacgcggcgcccgcatattttctcagtgcccacacaatgccaaaaccggccagtccccctgccgtcagagtaatgatcagattgggaacagccaggtaaatattctcaatgcagagcattttcacaatctgtcttctctccatcccaatggattccagcatggcaaattctctccttcttgccgttatgctgctgatactggtattgatcatattaaaaatactgaagataatgataaagatagtaagcccgtaaacctgtgtatttaaggcctttgtctgtgccgcatcgtctatttttttctccctgagagtctgcagcctaagatttttatagtcatccagtatgttcaggatatcctcctcgacagcctctgcattattcccatactcctctgctgtcacgtaaaaagctgaagttttattcatttccggccacatctcttccattacttttcccgaaatataaatgccgtcttccagattcctgtcatcatctgcacgctcttttaccccaacgatctgcacagtgcgctccctgtctgtgccgttataccactccagttctacctctttctccatatccagagatatttgaaatatggattctatgagtctggtgttgacgattatgacagagttctgatccagcctgtcggtacttcccgcatccagcagagcatccagttcttctctgttctcctctgtcaccggatagacgttctccatcagctctctactgccgtccctgattattgctgaagtgttgatttcttttttgacccgctttacattgggaatattctccagcttctgttttaactcttcactcagtgttccttccatctgccattctgtgatcccatacctctgtgtattgccgtgtgcatcgtacgcataatccacaatatattcccagtcttcaaagtctcccgctctggaatattcctcagcgtcccacgccgccatataggcagcacctgtcataaacaagataccccctatggccaatgacaccgtggtcaaaacgccctttttcccgttgttgttccagacacttttcgccatggttcgcgctgtcagcttcctgtgcggcctgtctttttcctctctgattttttcatccccggtgtatctcactgcctccacaggcgaaatattacccgccatcttagccggcttactcacagaaaagagtacagtgagcaccccaaaggcggctgacatacatactgtcaggaaaagtcctgccccagtaaagcccccgggcctgataaaatacgcagacacaatgcctatgagaatcccggcaggaatcccaatgccgctgagcataagcccctcactgaagatcatcctgtttatctgcttttttgtcatgccaatggttctgagctgaccgatctgatggatcctgcctgtcacagacagataaaaaatactgtatatgacaactacagcggcaaataatatgataagccccacaactccgatcaaaagcacagcactggttttctggagggaatactcaaaatttccgtttatattaacctggtttctatcgatctcatatttgacggcaagattatttaccacacccgaaaactctgatatctgcatatcccctgcgtccacaattctaaccagggctgtatagggaatatccctgagcgccttgctgttgtccgcataggctttcgagacatagacaggatatctgctcagctcctgatcccgctccaatatgccgcagaccacaaagctttccctctccccgtctgcaaaggagagttccagttctatccctgtcttctcctctttccccaaagcttttagaagctgtctgtccacagcaatttcattttccagctccggaacctttccttccgcaggagtataggtaacgattccgctgctgtggctttctatataaaacggatacagcttcactccatcttccttgacttcactaccctctttatagggaaccatcatctctgtctgctcatcctctgacagaccctgcatctgctgctctgtgatattcatatacatgacatgctgcatggtgtccaatatcttttgtttttccgtttccgcagatttttgtaccatagccagaccgcttatcagactgacagccaaaatgatggtcaggacagtaaagaaactatacagtctgtttcccagtaaattgctctttgcagttctccatacaacccttctgttattatttttatcaatattcatgaagaccacccgctctcaacaatctttccatcttcgatccgaatggttctgtcagccacttgggcgatctcctcattatgggtgatcatcacaagtgtctgatggaatcttctgctggctgcctgaaacagtccgagcacctcctggcttgtctgggaatccagatttcctgtaggttcgtccgccagaatgatggccggttttgtaaccagtgctctggcaatggccgccctctgctgctgtcctccggaaagctttcccggttttctcttcagtttgtcctcaagacccaggactgttacaatctccttcaggtatttgtcgtctgcactgcgtccatccagttctaccggaaggacaatattgtcatagacgttcagattaggcatcagattgaaattctgaaaaacaaatccgatcttacgccgcctgaaaatggtcagttcattgctgtcaagcccgctcagctcctgcccgtctaccatcacacttccccctgtgggacagtccagaccgcccagcatgtgcagaagcgtactcttacccgaaccggaccggcctacaatggcagtgaaactcccctgttctatttccatattgataccatcgagagctttcaccagaagcggctcttttccataatacttcgtgagatttcttgtctgtaatatattcatactgtgttcccctttcctgtgatactttcattatagccgtccattctctcaatcccgtaccaatattctgcatcaatcgtaccaatttcgatacaaaacaaaaggcggcattacgccgcccttcttggaagaaacacttcaaattctgttccgtatcccgcttttgaccttacctttatgtatccccccctgcagggtgatgatctgccgggccagatataatccgattcccaacccctccgttttcgccgcctttgcctcccggtaaaatctctggaaaatctggttgtaatgcccggaatctatgccgatcccggtatcactgacagaaatcacaatatacatttccagattccgtgcgcttacaattattttaccgccgctttccgtatatttcactgcattatccagaatatttcccagagcttccgcggtccatttgctgtcatgacaaacctcaagcgtttccctgacatttacctgcagttcaatccctttctcctttgccctggacgcaaccgtgtcaatcgcctgggaaacagtccggttcaccttgcagtgatcgggatgcatatgcatcatcctgctctcaagacgtgacattttagacagggcatcaatgagaaattccagtttgccgatctgctgcactatgatctgaacaaactgccgcacctcttcccctgacagttcctcctcgcagagtgtatccccatacatttttatgttcgttaccggtgttttcaactgatgcgtaatgtcagataccaactgctgggtctctaccttttctttctccgcagcgctggccttatactccaggatctctcctgttttcttaagttccatgaccatcttggaggtcagcgtctcctgattctgcacttccgagcacggattgccctccatgatctgttgggcataacggcatacatcccccgaatattttacatactgatttctgaaatacaggaagctgcccataccggctgcccatagcccccatagcacagcacacaagataacctttgcggcaaaggataccggctgcacaaagagaaaaatacttcccccgcatactgccagaaaatgaaaagctgtgagaaagagccgtatgatttttttcatattacctgctgcctcccacccattcataccccatgccgtacacggtttttatacagttgttctccccgtcctccagctttcctctcaacctgctgatatttaatgtgagtgcatggtcattgacataatttcccctgtcatcccagactttttcaagaagaagctcctttgaaaggatcctgtttggatttctgcagaataactccagcagattaaattccgtaggtgtcagagtcagcatccgcccgtctttgctgactgttcttctctcaaaatccactatcagatttttacagacatatattttggagtccttatccgccctggcacatcttcgcagaatggtctgtattttttccaccaccacacggatgctgaagggttttgtgatataatcgtctgcccctaactgcagtccctgtatcacatcgtcatccagattgtgggcagtcagaaaaacaaaggcagcggactgttttgtgagcaccttccgggcaaaatcaaaaccgtttccatccggcagattcacatccagaaggatcagatccggttcatgcccctttaaatattcctccgcctccgccagcgaatacgcaggctccacctcaatttcctttctctgcaggtgaaagcaaagacctgcgtttaatatctcatcatcctcaataatcaatactctgctcatatccgtccactgccccgttcttactcttttttgtatatttttgatgtttagtctatatatagatattcctgctttaggttctcttccggtatcggtgcggcatcctgaaaggtaacaatgtactgctgttttttacagactgctcctggtgatatccctcacccagttatattttttataatgtctgtaaacagccggaagctttatgatctcatccagattaatgatgaaatacacagccaaaattggtattttaaaataaaatgcagtcagcagcccaagcggaactgtcaccgcccacatggtaaccgcgtcgcagaaaaggccgaatctggaatctccccctgcgcagaaaatgccggcgatcacagtggaattcacagactttcctatgagataatacgtgcacataaagagcattcccttcagatatccgtgagccgttggactcaaattggaaaagcccaggatcagaggacttagcccaagaagcagaagacctgacagagcgcccatgaggatggaaagccggcagagcctgtctccgtaatcctttgcaccggacaggtttccctttcccagctcatttccgacgatgatcccgccgccgcttgcaagtcccagacacagacaggcgatgaggtttttcacaatattggcaatggaattggctgccaccgcatcgctgcccaaatgtcccatgataacagaatacatggtaaatccgcatccccatatcagttcatttcccagcacaggaagtgtataatgaaagaaatcccgcttcagatccccgtcagagtgaaacagatatctcacgtgcagttttacccttccgtgccgcaaagactccgcaaatgcccaggccagctccagcactcttgacagcacagttgccagagctgcccctgcaatacccatggccggaatcttccagactccgaaaataaagactgcgttcagtacaatattcgtcaccatggagacagagccgatcaccgtgctctttagggtattgccactgtttttcataatacacagataaatctgggaaatgcccatcagtaggtaggacacacccacgatacgcagatattccgctccctgtgccgtcagctctgcatccggagtaaaaatccccataagtgtttccggtataaacaaggctcccagaaagaaaaccagggatatggcagaagaaaacctcagcgcaatggcaaggattttctccacagacaccttatcccctttcccccaatactgggctgccaggatggtggttccgatggtcagtgccgccagaaacagactcaggacaaactgtatctgtcctgcaagggaaacagccgacaaggcctcctgactgatgactcccagcattatggcatctgaggcactcactgccgctgtcataaagttctggaaagcaatgggaagtaccagggtgaacaattttttataaaagattcctctgtcactcaccgttttccattgcctctatctcagcccatgattccgggtcaaattctctgtctttgtaatagtatttcttatctgcgtctgtgatctcacgtatcacacggcagggattccccgcagccaccacattggcgggaatattttttgtcaccacgctgcccgcgccgatcacaacattatcccctatggtcacacccggggtaatgactacatttcctcctatccatacattattaccgatggatacgggaattccgtactcatatcctgactgtctggatacaggatgcaccgggtgtcctgctgtatagatggatacattcggcgcaaacaaaacgttttctcctattgtgacctttgccacatccagtatggtacagttataattcgcaaaaaatcccctgcccacctggatatggaagccgtaatcgcagtaaaacggaggcattatggagacattttcctccgcgccgtctacgatccgtccggccagtcttcccagggtctcaaaatctgaggggtcagtggtgttaaattctctcaaaagtcttcttgtgatcttctgctgttcaaatacagcatcatctgatatgtagggaagtccggcgtccctgcgcgtaatattatccatctcttttctccttcacaaacaagtattttcatgtataataatagtgtattggttaggtgtattctatcaaaatatgcccttatcctataacaatcgtatttttgaaggaggttttatgaacggagtaagcattttaaaagacgcctcggaaattgtccattataacaaccccaatatccccctgtacctgaaagaccggtggctctcctcctacaccaatatggaagcactctgccactggcatgaggatatcgaatatatgaaagcactgaaaggacatatggtctattatgtgaatggagaaaaactgaccattcacgaaaacgacgcactgatcgtaaacacccgtcagatgcactacgggttctcagatgacaaaacagactgctattttgcctgtattgttttccgccttcatctgctctgcaccaatcccgagcttacggaaaaatacattcataccatagcagagcaccccgatctgccttatatccgtctccatgccgccaatcccgctgaggcagccattatccggctcttcgacgcggcatgtgaagactgccgggaaggttctgccggatacgagctgatggtgatcagccggctgactgctgcctgggtggagctttaccgtcttctaagccccggtctgctttcctacagcagcgttatagaggacgacctctccatacagagaaatatgatctcttacatatatcagaactatgcgcagaagctttccctgaacgatattgccgctgccggcagcatatgccgcagcaaatgctgccggatcttcaaaaaatatctgaacaaaacacccattgatttcctgaatgcctaccgcctggaagtcagtacgcgcctgctgacagacacagccatgagcatcacagagattgccctctcctgcggattccagagtcccagctactacgcggaactctttcagcatcacaagggctgtacccccagtcattaccgcacccggcaggcaaaagggtatttatggtaacagttcagtcttccactgtcccgcgaggtgttgccttgcatttgcaaggcaatcccgaggcagccacgcgccagactgcggtttttgcagtctgtgtgcatgctttgttgctatgaagccgaaaggctgaatagtaactatttatgatgtccatttcttcatgatctccagcagacgccccatctccagcggctttgccacatgttcgttcattcccgcctgctttgcctggtaagcgtcatcggcgaaggcattggctgtaagggcaataatgggaatatgggccgcatcgggcctctcacctgtttcacccagacggcggatagccctggacgctccgtatccatcaagtaccggcatctggatatccataaggatcagcgcataggttcccggcgggtcagccaaaaaccgttccaccacttcctgtcagagaaagattgtcaagtgtgtctgtaaacttttaaagaaaaaagatgcagcgcattgaagttttattctcaaatgcgccacatcatgattctcataatactctgccaaggattgttatttgaattgtgtttaatactttcaatcttaattttaccgtgtattctactgtaaccaactcctatgtataatttaaagcacaaatcaacatattttcttcataatccctgcatcaattccgtacacttcgtcacaaagaatatctatatcatcccgaacatgacttgcaataataatcagtttaccctgttctttcatcttcagcaaaactgttctcatttcttccacgccgttattatcaagtgcgttcattggctcgtccagtataagaatgtccgggttttccattaatgcctgtgcaattccaagtcgctgtctcatgccaagcgaataattcccaacgtgttttttatcatcaggatttaatcccacgagttccatatattttcgtatttcatcttttttaacctttcccctgacagccgctaaatatttcagattttttaaccctgaatatcttggcaaaaaacccggtgtctcaatgataaaccctacattttccggataatccacatcttttccgacaaccttgccgccaacggtcactgttcctgttgatggatacagtaagccacagatacatttgagcagaaccgttttgccggaaccgtttcttcctacaattccatatatttttcccctttcaaatttaacgcatacggtttttaaaacctcttgaccgccaaacgcttttgtcacattttctacaaaaatctcacatttatcttccatgaatatgcctcctgctgattctactgattactttctccttataatttgcagccacacataatacactgagacttacgattgcaatcatgaaaaatttctccgcgtatgccagattgattccccattttggtgcaaaaccattaaacaattccagctgcgtcaggcttaccggcgaaaacccatatgcccagtccagccagtcatttgaaacacatatatccaaaacagcggtcatcatcccggcgaatgttcccactgatttatccgtcatcttatttccaaaataaataagcaatccaatacataaaatacaggagaattccagcaggatacttataaccagcgcataggcaggctcatattgtcgtataatattctgagatactgacaattccacgccgaactctgcaccggcatttgttttccccaatgtcccccaaatcttgccccattcgtttgaccatgtaatatgcccaagaaaaggaataaccgccgcagcagccagacaagcagtataaagaattgatgtttttaaaatataaagaatctgtcccaatccccatgacagttttcccgctctggaaatcatatattgataagattcatcctcaaatggggcattacagaacaaaataactgcacacgccgctatgacaaactgaatcctgtaattattgattaaaaacacaaatgcaaatggtgtgacatttatatgcacgctctggctgaaggttgaaacggcagaaaggctttccatcacatacaatacaacaataataaggatgaacggtattcttatatttccccataacatttttatattatatcttgataccttatttgctttcataaaacatcccatctttaagtcctctcgccatctttcttgtaaaaacacatcccatcagaaaaaccaaaacacctgaaacaatgaccgcaatcataactgtgtatccgctgtccttaatcactgttctgcctatcaatatctggtcaagccgcaatttatcatcaatggataacatctggcttatcctgacaatcgcataactcccgaaaaacgggaacattgtaatgactaacctgtccgttacatataatgacacaaacaaagaaactccggcccatatcatcccacgcataaatccaagcactacctctgtcatacagtaacgaaccggggaatgaaccgccagccatttatgaaataaatctgcggtaccggcagccgatgtttcataataatcacttgtcatcggaaatctcgtacgcaaaaacagaatcaacaaaaccgtgccaaatgcaacaaccagtccgcccatcaggatatttactatatatttcacaacgccgtatctctgcattccctctctggaaacaatatacgcaaccgccctgctctttctttcctcacaaaaactggcggcaaaaggaagtaccgcaaaaacaggcaatatatattttctgcacattcctccgaaagcggaattgctcgtaaaatagtatacgcaccagacgctattgccgctttgcattgcacttaccaaatcattccatgaatcaaagcaaatgcaaaacataacgccaataaccgctatgacagtgctcgcatttatcgccctcttccattcatttatgaatactctgctcacgaaatttcctctcctgtgactgcattaaaccgaattgaatatctgctgtcttcaaccgattgtccatctacttcaaagtcaacgcaccataccggaatcaaatccatctccgtaaaggagtcctctctcagaagtgggaaatactccatccagatattttttgccttaaactcgcttgtcaaaatcacatcgccaaattttttcataattgcttctttgatgccgtcttcatctatgatagccacttccttctggtgttcctcataaggctcaaatattcccatcatacttatcatttcaattccattatttgataacagtaccgttacagtagccggataagccagaaatctctcgctcgtttgtctcaaatttggctcatttcgatatacgggaatcccatttaaattcatccgaaaaataatcctgtacacttccataccttcctcaaacgtatcgcttccatatccctttgctgacaaaaactgatagtcgccatcttccataattacctttttcacgttctcaaaatcggtctgattcatagcaaccacatcaagagcttccagctctccacccacgtcaaacattcctatcatgttttgtatccttgcaacagcatccgcctgggacataaaagataaatccctgtcatctgccagccccatctctcccgcataggaacaataggtgtccaaatggtttgcaatatcatttctttgataggtaagtgatcctcccgtaaattcgtcgctcccatcatcaacaacaagggttccttccgcattttgccctattgcttcctgcactttatcatagtcaaatctttttaactgcgtagcatattcataaaggttattttccggcattttcaattctgcactgatgaacaaattttcatccagtttttcatctatgaaaacaattgtgtcctgtgcatctccgacatcaatatttgttccatcctgtacttcaaccatctgagtgcctgtttctgtactaccatagtcaacgcttggtacttcttcttgagacgtgtttgcacaaccgcctaataatatcagaaaaacaagcatactcattgaaatcattaccgtctttttcatctttcaatttcctccttataatgcgataaattcaatttttctttttgctgttccgtgaaatcaatgacaattcccattatccatgtttcaatcatgatttcaacccatcttgcaccaaacgacattttttacctttatttggtcattttggcactatttcttatttcagcccaaattccacccaaaaatgtcttttcatgtaaattctttgtattctcttgacctttattgtataatgcaaggggtaaatgcagcaaattacatgaaaagaggtataaaaatgcgaatactcatctgtgacgatgatgctttgatagttgatcagcttcagaactatataaaaaacttttttgaaaacattggtgtgaaatgtcctgaattaatctgcttttctaatggagaatctctgctggcagataatggcgacaaagatattctttttcttgatatagaaatgcccgggatgaatggcatctatgtgggaaatgaattaaaaaaggcaaacagcggcattatcatttttattgtaacttcttattccgagtatcttgatgaagccatgcgctttcaggtattccgttatttatcaaaacctatagacaagcagcgtttcttccgaaatatgaaagatgcagttgaactatacaatactataacaatcaaaataccggttgaaacaaaacagggtatacacacccttcctgcctccgctgtcatcgcagtagaagcacaggcaagaaaagtaatcgtacatacaaccctgtgtgattttgaatccgtccataatatgcagtactggctgaaagaacttcccaaaaactgttttttccaaacacaccgaagcttcattattaactttgaacatgtcacggattttgatcattcccttgtcaatatggctgacaatcagatccacgcttatctgaccaaaagaaaatacagtgcatttaaagaagcctaccttctttatcttgaaagtacgaggtaacccaaatgaccaatgctgtttgttatttttttacttttctgatagaggcagtgatactgtggcagtattcctctaacctttttactgccagacgcagaccgtggatacagtttgcaatgcttttcattttttattttacaatgtttgccgtatccctgctggaatataaatggctgaatatggcattatattttgtcatgaattttattttcctgattgcccagtatgatcttaaatggtattctgcactgtttcattccgctgttttagctgccgttatgggaatgtgtgaattgactgtatacagcacgattgaacgtttctcgcctcatttccttgcagaatccggacagtttcagaatatgataatttttattatttttagcaaaatgattttctttactattgtatatatcctgattcatttattgaaaggacagcagacacctaaccagcagcatgacaaatccgtcctgcttctgatttttattcccataacctctgtttttattatgctcacattggtaagcgtcagtgattctttctttctttcacccctcttaaaaggaatggtcacgctaagcgcctttttcttactgataagcaacctgcttgtatttggcatcaaccagtacaaccagaaaaaaaacatggaatttacacaaatgcagttactgcttcaaaaagagtccaactctactgaatattatgaaatgctgcgtctgcaaaacgaaaaccaacgcattttgatccacgatataaagaagcatctgcactccattgatatgctgaaccagcagaaagaacatgataagatagatgcgtatctgcaccaactgatttgttcttctgatttaaaagaatccgcccggctgtgtgatcatgcaatgcttaactccattttatgccgctatatgcagcagtgtactgacagccacatagcttttcatactgatatacggagcggaacaacggattttattgctgacaatgaccttacatcattattctgcaatctgctcgacaatgctgtaaaagcggctgaaaacattccggaatcatttattgaaatcagtgcaggcaaaaaaggaaaaactccctttacagttctgacagtcattaactcctgccggacaaatcctttcacaacagaaaatggcagtctgactataagtataccccctggcaataaacatggtttcggactgaaaagcattcgcaaaattgtcgccaaatacaatgggaatatgcagatatactacaattccgatacgctgacgtttcatgcaatcattactttaaaacagcagggattatgaaaaaccataatccctgtctccacttcccacagcttttacatttattttccagcatccgtacctccatccgcaatccaaagcagtgggttatcttcatttctattttgctgctatttaaaaacatttttcttcattctataaaacttacaataacctatgtccattctctgttacctcgcccctttatccttatgccttgtctgatgcactctgtccgcttccctttcttttactatctgctctttctgcctgagacgttcttttatgctcataggaactgtcgctttatctccataggtcttgtcccactctgcacgatccgcctgataatcaaaatactctctcttggacgcattgagttccttattaaacgcctgaacagaatcaaatttatattcccttacaatagacgaaagcctctttttcatattggagatctgcttatcagctctgtcaatctcctgctgtaactccttacgcctgccgcctttgaaaatgcccgtacattcagacaattcctttttcagttcatcccgcttttgttcccgttcaaaaattgccctgttctggtctttcagtttgtcctcaatctctttcaggcggggatatttagccgctagtacggaaggttttggctgtagcggtctttctgtttccggctgttctgtttcggcagaaacagatttttgctctgcttttgtctgttcgataacggattttttgtctactgctacgcctttttgctgtggcgtctgattctgcttttccgatttccgataatggtcgagtggaaacggtatcttctttatctccggctgatgtgtcggctcatcttcggcttggatatggcttgccgattctttcggcatttcctttggcgtttccttgatggtggaagatttaccaaccactttctctaccatatcctttatcttctgcatcacttttgcaatcagacgctctaataataaaattgccgccctgacaatatccccaaacagctccggctttttcccgttctgctccacggattcctttaccctgtccgtaatctccgttttctttaactctaaaatctctgcttcggctactccgcttacaattgcacggtcaactgtcctgttccattccatgcggatttcattgtccgcttttatctccgccgctttcggattgtttttaccgattttctttgtagcaagatacggaccgttcttgtcaaagatactgagcctgtccttatcatcaattaccatctggttgattaaatctgtataaaatacttttgcctcatccagaaaagactcctgcttgaagcgtccgtcttttacagtaaaaatcttacgttcatatacttcgccttttttgatgatcttacagcccctgcggatattcccatcaccgtcaagaatctctttcttcgtccgcacatggtgtccctgctcatcgtaaaacatattccgtgtggcagtcttttcttccggctggtctaactgctttctctctgcaaatatcatatggatatgcagatttgttttacgcttattgtggtggagcgcagcaaaacactctacgccatacttttccttaaattcgtccaccatttttttcaaaagatagtcatggtcatagtttataaaactctccggcagggcaatcattagctcccttgcctcgatacacttcccgttcgtgccgcttttttcaaattcatcctgattacacttggcaagttcccgccagaatgctttgtccggctctgttgcatagacttcatacaaatgctcctgcctggcatggcttgaaatataagtgatgcgccccgataagttatgcagtttcgccatttctataaatgaatttcttttcacgaatgcctttctcctttcccttggtggataatctaatgccgccgcttttatatgagcagccgccatagggcggcttactgcgaaccgctacccgtatccaggcggttcacggctgtctatttctgacagccgcagggggacttctgcgaagtcccgtcaatgttgctgcgcatttgctcaaaaatgtagccgcccacagcaacagcatccatgcgcctgccttttgtggcggcatggataaatacagtccggttctttcggactgtaaattcgcgcctgcgcgaatctgccccctgcaagggcgaaatccccggagcataaaccgaaggtttgtgcggagggtgtatttcgctctcaaacgccgagggcttaggggagagcttgcgccctccccggaaattagttcctgacactccccgaaccactccaaagcagttcgtagagcagatgcttcacagacatcaaaaaaccgcctgcctgaaaactggtattccagcttcaaaacagacggctacatttacgcctttatttgcagccttccggctgctctttgcccttattttgcgggcttaaatgcccgccctttattatgcagccttatatggctgctctttgtccttattttgtagccttttggctacactgtgctcttgtctgcttaaaatatggttgcatttattgtctgttataaaaaatccacaaaaataaggctacgataaatactcttaccatagccttatccataaccatattaaaatgcgtcaaaatcaatcagatcattgtccggcggctctgtggaatgccctgcttcggcatctccgctctgcgccgtctcatttttcggagcagtgccgttcatggcaccatttcctgtcccgtctgccaatgcctgcccgtacaccatgccgccctgtgccgccgcataagctcccatagggacagataaagaaaaagcctgcatctgcgccatatacattccgaaaagcgccggaagattggacagcactttcttttccaccgtttccacgatacgctccgcaaaagcgtcctctttctcccttgtttccagatagggatcacgctttaccgccacacagcggtcataataattatttactgcttctatcacaaatctgttctgtgacttgaacatctgccgtatctgtggggagtgcaggagttgccacgccctgcactcgtccgccttttccgtgttaaatcgaatattgtggtttttgttcttcatctggatgcaccccccttatccggcagaagccattttcttctgcctgcggagtttcatataacagaaatattcataccctttggcatttgcccgtatgtcatggttgaaggtaacattatcactgtcataatccccaacaagctccacaacctttgctccgccacccatgacatgcagcttcataaggttaggattatagccgtgcgccttcagttccgcaaatatcttatccacataagattttgccgcttcttccatgagcgccttgtattcatctcctatatcagtgctgccatatctgagataattctcaataatctccgccggaagttcatctgcctttctgtccagaataagattgcggattgccataaaacattcatttgcacccatctttaccgtccacgatctgctttcgctcgcctttccattgttgagtatcatcacattcattgtcccgtttcctatatccgctaccatgtgcatccccttaaaatccggcaggctctccgctaccgccgcatagcactgcggcatgaccgtacagtccacaatgtcaaccacataacgccttcccgcatatttgtaatctacatgccggttctgcatcatatattcccggaatgaatccctctgcgtctgcacccattttaacggaagccctaccgcaagatggatttttgcagaataaagacttcttgcatttaattcctttgcaatggcggcaagggtaaggatataattatcgtcatccatgctcttttctgccacaaaatccttatgcccttcgcctatggtgtaataactgccttcatattccaaaaagtttctagtaaaaataggcggctggccactcctgctcacagaagtcgggaaacagcacctcgccgtcttatagttcccatatcctgcatccacgcctaaaataattgttccgttcatattataatctctaagttttgccattaaaaaagtctcctttccaatccagtcggcgcagagccgatgccccggcatttatgcctttggcatcgtgcgccctcttttttaaagttgctgttcataataaaatcatctgccatacttgcgtttcacttcttcttttgtcggaaggctaccgtctacaatcactttattttccctggctaccatagccgcaacctgttccatgctggctgtattcaaaagttcgtctgctgactgtccggcttcctctatctgcttctgcttttctgccgcatttgcaccctcaatcagccgccggatctccggtctgtgcttcctgcggtaggctttctggtattccctgctgtattggcggcgtttccgtttcttttcttcctctgccatttcttcctccgaaagttcctgtgccggaagctccaccttcccgatataatttaagaaaatctcaatctcctgcatacggtcgccgtccgttttctctattttatgaaccatgaccttgtccacaaattcattgacgatggcaggcgtaagttcctgaatatcggtgtacttatggacaaggcttaaaaattcctccgtcctgtccgtatcttcttcaaactgcatgagtttttcctgaatttctcttatagaaatctcaatctcctgctgttccttctcgtaatcggaagaaagcatttcataccgtctggccggcagcttccccattgcattgtcctcatacacctttttaatcagtaagtcaaggtctacaaagcgcttctcttttttcgcaaggtctgttttcagctttttcacttcgcctttgtccctgacctctgatgcactccgcatactttttataaatgccgcctcgtccatgcggacgctttttaaggcataccggattgattcgaggataagctgttttaccgtatcctcttttatggaatgggaacagcacacctgtttatacttttttctgctgctgttataggtactgcaattaaaacctgcggaggtatgctggacttccccgttcggaattccacgccagtccctgccagccctcgttgtacccctgcggtagtgcatcttcccgccgcaatccgcacagtagagctttccggtcagcaggcttccttccccactggtatccactctccgcaccgtttttcttaattcctgcaccagataccaagtcctgcggtctatgataggttcatgggtatcctgaaaaataaggatgtcctcactgctgtttttaaccgctttcttatctttgtaggattccttatggctgcggaagttcactgtatcgcccatatattccggtctttccagtatccgcaccaccgatccgcccgtccagttgtagggagtttcaaaatcgcacatggttttgaaattgcccctctgccttgtcgcctgataatatgacggtttctccaccttttctgccataagccgctttgcaatctggtacggtcccatgccctccacggtcaaacggaaaatctttttcacaacctccgccgcttcttcatcgacaagccaacggtttttatcatcagggcttttcacatatccgtatggcggattgcttgtgattggttttccttctttcccttttgcccgcaaaactgcggtgatcttcctgctgcagtcacgcagataccattcgttcatgatattcaaaaaaggggcgaattcactgctggtgttgttgtcactgtcaacaccgtttgagacagcaataaaacggacacccttttcccggaagaatacctccgtgtagaaccctacctgaaggtaatccctccccacacggctcatgtcctttactatgactgtgccgatgtcgccgttttcaatccggcttaacatctgcttccatcccggtctttcaaagctgccgccggaaaacccgtcatccgtaaaatgcaccgtgttcgtgtacccgttattttttgcataatcctccagcatctttttctggttgactatgctgttgctgtcccccgcaagatcatcgtcccttgagagccgctcgtaaagagctgttattctgttgtcaccagccgtcctgttgttcattccgaactcctttccggcggctggctcatctgtggtgaatccatcttaacataactttctgcgcctgtcaccatttcattcaaaattaaccggggaattttttcatccagcgtgtcggcatatcccgaacccgtatataccctgaccttgaaaagcgtcccgccgatcctgcggtaaaaaaatccagccgcagaggggctggtttccgtgacatcattattcaattttactgtctccatcatgcaatcctttcttgcgcttcatacgctcatcctttataatggttcctgtgcttccgttcttagtaaccggatttttattttatccgtactccatatcccgccctccttttctgtaatttgtttttagtcaaaaagaattactcctttcactaataggagaaaaacggctataaaaacggaagtgtttttgaaaaaactgctgcaaaattttatttttttgaaaaggactggttataaatgccgaaatatgccgaactcccgatattcagggagcagaattacataacggaagcggacggggctatgctccaccgtgaagcccgtgcgcttgccctccggcgtattgaggaaagcgcacggacggaagatgatttccaaaaagtcattgaatggtgggataaactggacgaaaacagggagcggagagaaagagaccatgaaacaggacgctccactgtccctctggaatggggtgccgatgaattgtacctatccgacagaccgtcttatgatatggttctaaaaacgctcctgcttgcaggcgattttcttgatctcatatttgacagcccggaaatgatacatgaacttgtcacggatgcggatttatcgaaaatattagaggaactaaagccgcaccttaaaaatatgctctattatctgttcctgcgtgattattccgcaacagagtatgcggaaagtatcgggcagtctgaccggaatatccggggtatccgtgaaactgcgctgaaaaggatacggaaactttacggcggcatactcgcatacaggaaagaaaacagcctgccgatgacgcttgatgagaagtattttctggaaaatggagtgcggaagaaaaaaggaatataaatgtgtcccaactgaaaagcgtaaacggcttgaccgataatgagtaactgtttataatataggaagtattacatcagataattcgatatgattgatagattggagcaggttttctatgaagaatttatttgagcataccagcgcaccgtggattcggtacagtagctatgaatataagaccgctgatgacggcgctctctacataacggtttcaaagggtgcaaaaccggaaatgtaccgtcccatgcaggaagccgggcagcttgtcgtggatgcggtgaatgtcgggctttccgccatgcacaaagtcccggaagaggagctgaaagagtccgtgcttggctttattaaaaaatatggttttctcggctttatgaccgccctgccgacaacggcagactttataacatatgaatcggtgtatctgccaaaaaaccattttataaaagaagaatccctccctacagaaaactatttttcctatttctacccgtttgacaagcttgatttcaaaaagagcggtatagaatcgggatggtctgtgactgaccgtgagggcattgctatcacaatggctatggagaatgcgccgcaggctgtggcgatggagctgcagaaagactatgcggaaaggtacgactggatcgtaaaagaatttacagacctcgcctttacctttgtgacgagtttcctttattacatggattatgataagattgatgagcagacacgcagcctgtaccgtcagggcatttccgctttcggcggcatagccccgacttaccggattgcgctggaaaaggatgctcccgttatcgtatgggacttccactcgctgcttgtcatggtgcagatgtgcttttccttcatgctcacggacaaggacagtgatatgcgcctgtgcaagcattgtaataaagcctttgtcgccacccggagggggaatgaattttgcagtcagaagtgcaagaaccagtttaacgtctacaaatcgagagagaagaagaaagggaacaaaagcaatgattgaaaacaggaatgtaaatatcataaccgatgcggacggtaaaaagctggtcttaatcaatgacatccgtttcaaggcaaaagtgcgggatgactggtctgttgtcgaggaatacctgaaagagtatatcggggatttttatgaaattgaggaaacttctgaaaaaatatttatttcggctgattttcccgatgaatatgcaagttcagaaagccgcattgccttaaaaggcgcagtggcaaaagctaaggcgaacgctgcgcaggctattcctgaacttataagaatagctgccaatcccaaacatgaggcaaacagaaaagaaaagcacaaaacagatgcagtatatgggtggtatcgttacaacattagatttgcactgcctgtatatgatgacaaaacgggaaaattagcaaggcataatatttattcggcaagtatgcttgtccgccatgcgaatgatggcaggaagtatctgtatgatattcttgcaataaaaaaagaaacgagcagcccgcttgagtgaaaacactgtacggtaaaaacccatttcttattgtcaataataatctattttttaattcctgtcaatccccaatttttatttttcagaataccgccattggcatttttaatgcaatgggggaactttgtttccccttaaccactccatagcatgaggcgcagatgatgtcaagaccgccgcaggcgaggcggagctggtgtcttgacatcatctgcgcctcatgctacaaaacttaaaatcgaagcaactctaaagggaatatattagatcatgcagcactacctcctccgccctgctcctaatactgttcattttttggagccaacagagccagtcatcggatttaagcttctccgtcaccccctctttctttgccatctgccttacaagcctgtctatcatttcattgcattcttcatcgacttccgcaagatgtttccataaggtttctgacaaaatcatatacgaataaatgcctccatgattctccttcaaaaaccgttgcctcattcttccatacttcccaatctgatattccgttgtatccgaaagtttcaggtcgggaatcagatagtcgccttcccaatgatatgtaatctccatatacaaccgcctttctctgtgctaaactgtttacagatacgaataaaagaactatcaccttctccctttaccacaacatctgcaagtttccattcaccacaaatgagccagccgcatatgttgtattttagcagatgtccatttccgctaaaatactgcgtttgtcggaaatgtttacatctacagttcacaacatatcacatccgttagaggtgcaaacggaattaataccggagagagccagcagttcctttacaatctcctggttgagaagattatcttctgccagaagcacacaggcacccggcggcagtacggtttccaccaccggcatatccatggtctcttgttcctccccgatttccgtcttctgcgccagcttcagatatatggtcacaataaatcttgtaccctggttcagacggctctccacttcaatggtgccgttcatcatctggaccaaattgcgggtgatggccagccccaggccggttccctgtatccggctcacccgggagtcctcggcccgctcaaaggggagaaacagcttcttcttaaattcctctgacataccgatgccgtcgtccgctacaacgaattcaaagcaccccaccccgctttcgctggaaagcttctcctccaaagtgactgtgatatgtccgctctcatgggtatatttcactgcgtttgacagcagattgaggaggatctgcttgatccgcaccggatcgccgtatacagaagggtgctccacatcttttatgttgacagacaaatggtgtctctttccatctatatccggcctgatgatctgtgaaacctcactcagaacatctctgagacagaaagcatcctcgctcaggctcacatttcccgactcaatcttagacatatccagcacttcattgatcagttccagcagatgtgcgcctgagagctggatctttttcagacagtccgcagtctttttctcatcgcccagtgtcttttccgctatggccgtcattcccagaatagcattcataggtgttctgatatcatggctcattctggataagaagtccgacttggcctgattggcccggttcactgaatcgtatgcctcctccagcgcgtgttttgcctttttctcctcctcgtaatactccagctctttttgtttttcctcactgatattccggaaggcgatgataaccgtctttggcctatcgttttccgctgacaccagatggatctccattctcagccacaggacggaatgcttatgcctgaactccacctccagatgctcatttttgcctgccagttcccgcagaagcctctccctgctgcagatatccgccattttattcagatctccaccgtcgatatcctccaggatatatctgcagagcttagtggaatatcttcccgtcctgggcagacttccccctttatccgcctcaggcagccggaccgcgtaatagctgtcattctgcagatccacataaaaaatactgacatacacatcattgatggcttgaagcgcagactggctcatgtacaggcgctcactgctctctgacagctttgatttcatgctgtggatatcatgaagtgcccccactacacggctgggctttccattatccatcatcagtctgctgttggccctataccagaaatactgcccttttactccgtccggtacagaacaccgcacttcaaacacctcggtgcggcctttgcagatattatctatcacagtggccacatcgtcaggatgcacgatctgatccttcagcagccttttggagtaatctctcaattcatggcgaagcacaccctttccttttcttggctcaaaactgataaatacatcctcatcgatcaaatattcaaacataacggaagaacctgcttccatggcaaggcggtacatctcctgctctctgtccagacgctcctgcagcgcttttctctgagtgatatccaccactgttctctgaaggattttttctccgtccggtgtggtatccaccaccatattggtggcattcatccaatggatggacccatccttccaccgtacccggtattcaatctcctggcagtcacccacacctgtcatctgatgataggtctcctggataatacttttgtcctcaggcagcacagctcccatggtgccttcatgccagtcattcattccctcttccagactgtcataccccatcagagacagtgccgctttattcagggaaatgagacggtattgttcatctctgcactgcataaaccggataataccgcaggggactgtatcataaatacttgtgagaagctgggtctgctctctcagcttctgtgcagccccctctgagcgcgtgatatccagatacaaactgttcaccatccaattgccgtcagcatcctgggcctttttcccactgtcaatgacccacttcagactgccgtccctgcaacgcacccgatagcgggtggaatatgtaaggttgccgtcccgaaatgcctcatcacaatctgccaatgcttttggcagatccggtgggtagactgtccccacagcagtaccgccggttactttcataaactcttccacagtatagccgaataaggccgccgcttctttgctgacaaacgcaaacgagtacgtgtcgtcatcattactgatcttcagtccgcctgcaatggaggacatgatgacctcaagctgtctgttccgctgctttatctcctcctccagttctgccagcctctcctggacataatcataagactgcctgccaatcttgtcaggaaaatgttccccgtccatcatctcctgataggggttagaacagtggatatggcagcacttcaatccttcctctgtatcctggaacacaaaggtcactctctggtgcaccttcagatacatctccacactctgatccgtagcgatccacatccgccccatgaccacatacatgtcctcctccggacatatcacatcatattcttcctcccgtatggtacagtcaggaataaactccttgtattttataaattgctctgtacaggcctcccgcccggacatacattcctcctcgccggctcccagccaggaaaactggggtgcaaaataagaggtgatccattctgtatcatgttcacaatagtgtttgtgcatgatgcagcctgccagttttttaacttcctcaatccgttgttcgtacaccatctttgatcttaatttcacgccgattcaacctgctttcctgattacctttgctcatccgatacttatcaatactgcatgggaaaagaaaaaccatcctgccggaatgaattttcaaacacgctctgggatggttctgtttttcactgtaataacatgtaaatattctatcacgtttgcggcatactgacaactttaatccctcagtcgttttgttttcctcactttacggatctttccttttattggttttgcctgaagacattttattacctgttctcccttaaaattcaaaacttccacgtagctcagactgtccctgatatccacaatacctatatcagaagcttccactccgtcaagactgcaaactgcacccacaatgtctcctgcccgcatttttgatttcctgcctccgccgatggacagacgggtgatcccctcgttcagcgccgccccttttttgggctttgcctctgtttttatacgctgggatttccagaataccttttctttttcttcatccggcaccggaagctccatacagggcaggttctgccccacaaactcctccacctgcttcagcatcttcttgtcttcttctgtaaccaggctgactgcagtaccgcattttccgtttctccccgtccttccgatcctgtggacataggtttctttccctgtggggaaatcgtaattcaccacatgggtgatctgttcaaagtcaacacctcttgcagccacatccgttgctatcaggaaccggaaacatcctctgcgaaaagcgtccacagtcttcagcctttccctctgctccatctccccgtgcagcatgccgcagaagatccgccgcctgcgcatcttctgaaacagaacatttgtcatctcccttgttccgcagaaaatcatacagctctgaggattttcgtccataagtacatgaagaaaggcatcgtatttgttctcctggtcagtaaaatacaccttttccgcaatagcagccgtctgctcatctgtcggctcctgcagaacatatgttatatggggaataaattcatctgccaattccctgatctccggttttaatgtggcggaaaacagggatatcctgcaattttccggaaccagggagaggattattctcacctgttcgataaatcccatatccaacattagatccgcttcgtctattaccagccattttaatcgttccagcttcaggctctccctgctcagatggtctgcaacccgtccgggtgtacctgtcacaatgtgagacttctgccgcaatgtctgaatctgtttatcaattgggaatccaccgaaaaccgcaggtactttcagacgttttttcctccctatatgaaacaattcctcgctgacctggactgccagttccctggttggctcaagcaccagtgcctggggtgcattttcctcccaccggacactttcacaaatcggtatgccgaaagcagctgtcttcccgcttcctgtgggcgctttcaccaccacattttttccggcaagcatcggcagaagaacctcccgctgtatgccggtaggttctctgtatcccaaaccgttcagtgcctccaaaatttcttctgaaagttcatattcgttgaatttattgatcattactattttacctttctttatttcggacgctggtctatgcttatccattgttttatccatctctctatttcggacgctgatctatgcttatccattattttatccatcgtttttcagttttatcttcaacagcgctacctgctggtcttttcttactatgtcatgtacgatattgtgaatctgttatatatcttatcaaactacaggaaaaattgccagacattatcactttctctttcctgtctttactttggagcatttatcttctaatctgtacatcaatgtatttttcttctgtttatatcttacataccggtattagaatcccttgcctgagcattccattctggtatcagattctctgcctttgcattctttgcttgtgcatcctttttccagtattataatactctgccggagtattccattctggtattagattctccgcttatgcatccttttccggagttaaattcctctgcctgtacatccctttccggtatcagacttctctgcccgggcattccgccctgatatcagattccctatttacattctgataaactatctctggaggtttttcttaaccgggaaaatgcaaatggcacttatgccgaaactcccacatttatcatcattttacctggtcttcaagcaaaaaaatacatactccataaccaaaataccagaaaaatcattgtacaaaattggattatttgtacatatcaatcaaaagcggatttagttataattattttataaaatatttcgtgaaagtttataaaatgctttactatacgggtatgtgctttacattatgtagaacattcccgcaaaaaggaaaaaagggaggatcattgtatgcgtgtcagataatttatgtaaacagtagtgaaactaggaaacctaaaagagcggaaaaacggcattcttccggaagttcccctggaatttccagaggtagaggacggcataaaacccaaagatattggctcaggaatagctgtgaaacgttggcatacatacaaatgtgtgaaaagggtattgcggaacgtttccataagcagtacggacatgagcaccccacagcagggcgattgctacccactgccatgctggaagattttatacacctccattcccggcaatatttgtttcccggaatggaacaactgtgtttttggtggatactgcacatattgcaaaacggaaaccaaaaacatccactatgaaaagaaagtgagggatttttatggaaataaccagcagtaaaaaagagatttggacaatgggaagttattctctgctgactctggcaatcatggttggatttatgtatctgaatacatttgccactgaggttctggtcattcccgcaggcactcttgcagtggctctcggcgtggcaaaattgctggatttctgcttcagcctttttgcaggtgccatcattgaaaaggtaaaaatcggcaaaaccggaaagaaccagtcctggctctatcttggccgctggatccttgccgtatctatcatggctgaagtctgcaacaccagtgccgcaccccttatcgtccgtgtcgcagtcctgtccgtatcctatacggttctgaactgtctgatgaacattctgcagactgcttattatggtgttctggccgctgttgccggcccaaacatggccaacagaaatgccatgaccatcaatatgacccggcagagtacggttatcaccatcatctgttccttcattccgacttttgttaccgtacttccttttggaaactggaactattttatcgttgctttcgtatttatgcttcctatgccttttgctttgggcgcaatcgccaaatgtgcagacggcaaggatgttcctgtcggcgcaaccggttctgtcaatcaggttggcattggcgatatgttcggcaccctgcttaaaaaccctcagatgctagttcttttcctggtatttaccattctctatattgcacagtttacctatcaggctaactatacctattacttcatttacgtagtcggtgattttaccaagatgactctcgcaaccctgatcaacgcttttgtgggcttcctggctgccatggtaatgccaaaacttggcgcaaaactcggcaaaaaaatgtcctgtgtgttcggatttctcatgatgagcgtggcactgatcctggtatcatttttcggtgctcctaatggtgttcccaacctgacagcttacattatcattatgtctctgctcatggccggaacctatacctggatgccttacatggttgttctcttcctggatgcaggcgaatatttcctttataaaacaggaaaggatactcgtgcgatcgccgccggtctggcttctccgcctatgaagatcggtatgaccgttggcaatacccttggtctggctctgttgtctgctatcggattcgtttccggaggtgcctttgagatcagcgttacatggatcgccaattttatgcgtgtcactttcatgctcccgggcctgatctatctggccgctgccatcatcatgctgctgttttataagatcagtgacaaggatgctgccatgtatgcacaggcaaatgctgagaaaatgcagcagggtaaataacagaaaacatattttacaataaatgtgtacccctgttaaatcgtcactattccaaatctaaataaaaggagatgaaattatgtcaaaaattccgtttaatgaaaatgaaatgaacatcgcttatactgttccgaatctcttcgaccctaccgtgccggaaagtcccgcctggacttatccacagtctgaaaaggatgcaatacaggaactgtatgccggaactcccacatggtgtccttccggtctggaaacggggctctttgctccctctgtaatcccggataatatcgcccgcggctttgtcatcgaaggaatcccctatgatatggcaaaatacggcggtcctgacatgttcggcgtggaatgggaatatgttcccgtggcaggcggctctatggtccgccccggtgctcctctgctggaggatgtcaatgactggcgcaaaatcctgaaattccccaatattgatgaatgggactgggacgccagcggcagagaaaactataaattcctccaaaacggaaaagcaaatatgctctggttcttaaatggctgctggtatgagagactggtgtccttcatggattttgagggcgcagtcgttgctctgatagatgatgagcagaaagatgccctcaaagaactgttcgcagagacaacagaactgtactgcagacttgtagaccgttgtgttgagacctacggagacggtatctccggtttcaccgtacacgatgactggggttcccagagagcacccttcttctcccctgcagttggtgaagaaatgatcgttccctacatgaggcagcttacagaccacattaagtccaaggggatgattgccgacctgcacagctgcggcagcctggagatgcagcttccaaactttatcaaagcgggctggcagtcctggtgtccaatgcccatgaatccgacacaaaaaatgtatgaagaatacggcgataagattctgctccatgtagaacctgatctgcccgaaggcgcctctgaagaagaacaggaaaaagccggcgaagaatttgtcaggaattactttaaaccaggcaaatactgcttcccaaacaccacatacttccccaagaaagtgacgcctgcgttccgaaagggcatgtaccgtgcttccagacagtaagtggtaagcagcctctgtttatacagacctattagtgatcattttgcttctcaccagcagcgcccggaagagaaaagtcttccgggcgctggcgcttaacggcgtgtcttgcaggcatatcacactgtaatatacatgctttttcaactatgctttacgaaagagaggaacacaaatgtctgataaaaatccgactccggcaatcccgccggtagaaaataatatcatgggtaccgctcccattccaaagctgctggcgaaatttgccataccttctgtcatctccatgctggtaaactccatctacaatctggtggatcagattttcatcggccagggtgtgggctatctgggaaacgcagccaccaatgtggtatttccttttgtcaccattgctatggcgatctcactgatggtttccgtgggcaccgccgccaatgtagggttgcatcttggcggcaaggaacaggacagcgctgatctaacccttggaaatggccttacacttgctctgtcaagcggcatcattctctgtattttcggtgaaatcttcatggttcctctgctgcgcctctttggtgccaccgacaccgtacttccctatgcggtcgattacggacgcatctatttactgggcaccatgtttaccagcgtaggtatcatgatcaacgatgaaatccgtgccgacggcaacccgggctacgccatgaggtccatgctgatcggcgctgtgcttaactgtgtactggaccccctgtttatctttgttttccactggggcgttaagggagctgcccttgccactatcatcggccagttcggcacccttgtcttcagtctgctttatctaaaaaaattccgcacactgacaatgaaaaaggagaatatgaggcttcgtttttccatcgtaaaagacatcctgacgctgggtctctcctcttttctcacacagtgtgccgcactggtcatgcagatcatcatgaatcagcagactatcaaatacggcgcgctttcccaatacggcgcagacattcctctgacggtatttgggatcgtcaataaagtaaacggtctgatgatgtccattattatgggaatttccgttggtgcgcagccgctattcagttataatttcggtgccaaactttttacacgtgtaaaaaaactggccaaaacctgtttgattgtatgtgttaccatcggctttctcggtatgctctgtctgcagctctttccccagcagatcatttccatcttcggtcaggaaaatgacctgtataatgaatttgctgtaatgtgtctgaaaaatatgaccatatttatctttgttatgggcgttcagatggtcgccagcgtatatttccaggcggtgggaaaggcaatgggagccacagtgctctccctgtcacgccaggtattgttcatgattccctgtatgctgatacttccttacttctttgggatcattggccttatgtggtctttcccggtatctgatgtcttttcagtggctatggccgctgttatgctgactgtggagatgcggaaactgaatcagttgatccgggttccggttgtgcaggaggcttgatgtgggaatagcataagctttatgtgtagaaatatccggtcaatctttggtttgtgggatgattggccggatattttgatattttatgtttgggggtgtatgcttatttagaactcaaaaattttgatggatgaaagaaaatattatcaggcaaacttactttatgtttcttgcagaataaatctataaattggtctgttggttattggcttcttttatatgcatgtgtaagttcttttttgagtatggaagataagtatgtaaatatagattttctatgataagtatagcactggtaagggagtgtgaaactttttctgtaaatatgtgattgaaaggttcttctatgataaaataaaaatcataggagggccttttattatggcaagagaaaagaaacccgtacacagagtacaaatgacggaagggaaacgcagcataatccatcagctcctggaggaatacgatatccaaactgctgaagacattcaggatgattattccggggctcattgagccatctgtccggactttgagagccaccattccggagaatgggagccatgtattccggtaattcagagccattccaggctctattacatatatttcctttatactgtagatacacacttttggtgtgaatacagataaaggagggtcaccattatgaccaaatatcgtgaaatccttcgcttaaaaagcttaggatttagtgaacggaacattgcacacagctgtggcgtgtcccgaaacactgttgcaaaagttacccagaaagcaatggaaatgaatctttcctggccattggattttgacatgaccgacagtgcacttgcggaactattgtttcctaaaagtaaatctgccaccaaccggcggatgcctgatttcgattacatccgtaaagaacttttacggaatggagtcaacaaaaaacttctctgggtggaatactgcgaggaatgtcgtctaaacggcgaagatccactcatgtattctcaattctgctattacatccaaaaggaagaaaaaaaacgcagagcaaccatgcatatcccaagaaaaccaggacaacagattgaagttgactgggcgggagatccggctcatatcattgatccggatactggtgaaatcacagatgcatggctctttgtaggagtcatgacctacagccagtatgcgtttgtaaaagcatacatggatgaaaaaacaaacaactggatcaaagctcatgttcagatgtttgatttcttcggtggtgttacaccaatgcttgtttctgataactgcacaacagctgttaatcattcaaaaagcgattggtacacgactgccttgaataccacttatcacgaaatggcagaacattataatcttgccatcattccggcgagagttcggaaacccaaggattatcggcaaaaaaatgttatcagcaatctcagcctgaataagcgttataatcgcattttcaggctgaaccgctgtctttgattgccgataattatttaatccagaccacaaaaatgaagcagatattcttcttttcctttccatttcttctctggataagatacaatgctaccgtcagagtcctttacaggcagtgcctcctgatccactgaacgaagtgcagcagccattgactcattatctgcatgagcatagattgatgttgaatcgattgatgagtgccccagaaagtccttgatataaggaagaggtatgccggatttaaacattgacattcctatactatgccggaaaacatggcagtggagcccttctggaaaagtcggatctactttatgcagttcttttgcataggacgcaagaaaagaattcactgttcttggagccattttcgtacgctgaccattatggatcgtataaaaaagataatcctgattatttctgcctggatgaaattcattaaggtaagcatccaaatgcggtaagacttctgaaggaagaggattatatctggttttgttcccttttccatggagacgaatctgtacacttgctccgttacggatgatatcttccagcttcatgttgaccagttcttcaatcctgctcccggtttcataagcatggatcatgaagtattgattacggcgtccattccgagttgttgtatctggccaggataagatagattccagctgttttggtttcaggtattcaagcttcggatctgttttccccttgaaacggcggattgattttactttcagatataattctgataacgtgacatcttcttcactgcagtaacacaggaatgacttgattgctgagagtctgagatttattgtgttgattgcttttgcctcactgtctcttaaccagatgcagaagtcataaaccatttcttttgtaaagcaatgaaatccaactttatcaaacgggatctctttctgtgagcgaaggtattggcgatattgatccagcgaatccgtatagtttttaactgttgcctctgtgaacttacgctgtacgattagatacttatgcaggaaattccggagaagttcataaaagtaaagttctgattttttaatcttcatgcggcacctccggtagtatagaagcatttatggagtacatacgagattcaaactcagagtagaatggctcagccagtgtaagataataatccgtatctgcaaagtttgaatgtcccataaattcactcagataaggatataaagcattcagatccgcatgttcactgacccattggttcagcctgtagacacagtaggaatgacgaaaatcatggactctaggcggatttcctttcgtaatgaccgcttccggaagcggatcccagaattcatggaaccatacatctaacgtagatttactataataatctccagattgattcggaaagaatgctgtcctgtcagggtatgtaattctgatgatacggtcatatcgacatagcagctccagcatgtcatcgctgacgaaaacaatgcgggcttcccatcctttggattccctgataaaaatctttcctgtagaaagatcgatgtcatcagtgcgtaaaagcctggtttccgaggctctaagaccgcaggtataaatgagtcgaaagataacaggtatcacatagcatcgtaaaggtgaaaagggtgattttttacaggtgtctatagaagcaaagaaagcctttaactctgcttccgtaaaaatgtgggcatcatatcgtatctgttttcttggtatcccgtcaggaatgatatatgcagactttccagtccctacaatgtatttggcaaactggcgtaccggagtcacccgtctgagcaaagtgttctgatgcagtacggaacatttccttatccacgcatcacagatttctttggatagggtactgcagtccggataatcctctgcgatcatggtgtcaagatagcccaatacttttgaagaagtatcataagggtatccagaggctcttttctgtgagatgaatgttttaaagtcatcccgaagtttgctgcgaaaaacaggatcagacaaagtcatcaccttctttccagtatttctgcccgatcatggaaaaatcaagcggacattcctttaacatctgttcttccattgacagatatggcttgtctgattctttggaagtatgaccaagggcatccgtaattatctgatgcggtatcttgtttacaaggagcttatgcgttagtgtataccggcaaacgtgtaccccgcggctatccttgttaacagtccggatttctgctttatcgaacagtttggagcataccatgtacatagactcaagctttttatatggtgcctgcattcggatgaaaatatatggatttttttttgcttgagcaggtcgttcgttcaggatatagtccataatggcatttccgacatcttcaagcagtggcaggcacatggtcacaccagttttttcctgttccagtatgagctggtcgtttttccagtcaatttggctgaagcggagacagcagatatcaatgtcgcgcaatccaagccggagccccaaccgcatcattgcttttgtacgaagcggtgccttctccattacgcagaaaagcttttcttcatctctagcagttatatatggccttaaatgtgtgtttttatatgcgggagtcagaaccattcccgaaaaatccatagaaataaacccagctgcatacagatatgacagaatctgccgtatgatagggaaaacagttccacgactgctcagacaaagcctttctgacagaaggacaagcatagactggatctgtgaaggctgcagttcggcgagtccattaacatcgaggactctggttccttcgataaaagagctgaaagtataatcataaagagcaatcgttttcttttcaaaatttctggtcttcagaaacgtaagatactgctgacggagtgcttccagagtgtcatcagaacaacgggggttctcagaaagaaactgtttccattgaaaacagccagagtccgccacttcaaacagtacacagacagagcggcgtcggatttttcgtttccactcatgcaaagagccatctttatgcttttgagttgtatcttcgataaaagcattacaggattcccgagagaatacggtaccacaggaaagatagagaaacgtatataactcccgccatgcctgcatgtattgccatttggtagatgcagaaagatggagataatccatttcacattcagcacggcgaatcagatgccctgtatcaatcctgccatcactgacaggaaaagatatatttttgaaatttttctctgattcactggcggaagggagcctcggctcattatagagctttccttccggtgtaagcgcttttgttccggcttctttgtctattagacgaaccgcatgtaagagctgaaaacggagatccggtgtcgatgcacgtgcaacataggcatcatatagttcctgacaaggtactgtgatacacagacgctcactatactcaaccagatgtttcacgtaatttttccgtgcatcatatgtcgatggagcaagctgcaacttttgctgttcgaggacagcatttactacttcttttaactgattcatctcaatactcctttctgccacgggaaaatcccgtagtcaatatcaggatagcaattgagatagtaaagcgaaacattatcagcaaaaatatctttacagatatcggactattggcgtattctgagaagcatttatagattttccgataacatttttttgccgataatccttgttatcggtaattaccgataacaaggataaaccaaatgtagaaggatctgtcggaaaaatatccacatggatcacagcagcccttcgaaatgaacagtttttctcgctgtcggaattaaatgatgcaattagagaaaaactggaagcctataatgctcgtaaattccagaaaaaggaatgtagcaggctcagtttatttcttggggaagaaatgccattactggcttcgctgcctgctacaccttttgaacttgcagagtggaaacaagccactgtacagttcaattatcacattgctacagagaagatgttctactctgtaccttatcagtatatcaaaaataaggttgatgtgcgtataacagatacaacgattgaaattttttataatcacaaaagaatcgcttcccaccgcaggcgctatggtcgaggtggtcagtattccaccgttacggaacatatgccgcaagatcaccagaaatatctggagtggaacggagaccgtttccgtaaatgggcagattcgattggaattaacacacgtaaagttgtcgatgggcttcttacctccggcagggttgaacaacagtcctacagaagctgtatgggactgttaaggctggctgaaaaacattcaccaacaaaactagaacaggcgtgtatgaaagcactaacctattccggaaaacccagctacaaaagtataaataacctgctcgctgctatgaagaatgaacctgattgcgcgtcagatcattcctccgcatccgagacagcaacaagatcacatggcattaccagaggtgctagatactatggaggtaactaatcatgacaaatcaaagtacactcgataaacttattgaaatgcgtctcacatcaatggcagatgcattccgtatccagatggatgacagcagcatgaaggaagttccttttgaagaccgttttggtatgctggtagatgttgaatacagcaaccgtaaaaacaaccgtctgaaaagattgatccgttcagcagagttggaacaacctgatgccagtattgctgcaattgattatcaatccgacagaaaactgaataaggagcttatcagcaggttggcgacttgtgaatatatcacagaataccgaaatatttttattaccggtgccaccggaagcggtaaaacttacatggcatgtgcctttggaatggaagcatgcaaacatcattattctgtaaaatatgttcgccttccagatttatcactggacttacaggctgcaagagataacaacacatttgctgcaactctcaaaaaatacaccaagccagtactgttggttatagatgaatggctgttattgaaattgacagaaactgaagccagaaacttgtttgaactgatacataaaagacgtaaaaaatcttctaccatcttttgttcacagtttcgcgaaagtgaatggtatcagcagatctgcagcggtgaaagtacacttgcagatgccattatggatcacatttcctatgattcatataaaatcgatattgaaagcattgatccaagtaaagacctctcaatgagagaagtatatggtctggatccggcacaagctaagtaatgaaatgaagtggctccgttagtccggacaggtggctctcgccactccggactggcggctccgccgcaccgtaatattcacaggatgctctgaaagatcttctgggtggaacgtaagcgccaaatattcttgcggatttcctaatactctggttttctctataattgtaaatgaaagatatttagactatttcactacaattacggagggtaggttatgacagctacacgcaaagcccgtgttccgatggcggaacagatcaggcttatcaatgaatgccgccaaagcggcatgacagatgctgactggtgccgtgaaaacggtatcgctgtaagcactttttataactgggtcagccgctgcaggaaaacagcagcggatcagatcccggcaccgaattatggtcattgtgtgatcccgcattcaaagcaggacgtggttcccattgacattgttccggatcgacttacggaacagcacatagcatcacagatgcaccaaacgaaccttgacaattcacatacgattgaagtgtccatgaatgatgtgacaatccgcatcagcaatgatgccgatcctgtcctgctcaccaggacactccgcctgatccgggagaccgcatgttaggtgatatctccagcctcgaaaagatctacattgtctgcggctatacagatatgcgcaaatcgatcgatggtctctgtgccatgatcgaagaccagcttaagatggatccggcatccagtgcgctcttcctgttctgtggaagaagacgggacaggatcaaagctctgttccgtgaaccggatggctttgttctgatctataaacggttgtctgtccggggcggctatcaatggccaaggaagcagtcggaagtccggaatctttcctggcgggagttcgactggctgatgtcaggaattgatatcgaccagccaaaagcactcaaagcagagtaaaaaagcagctggatcccggtaaaaatcctgcacagaaaaatgtctgatttccttataaattcagcgtttttcaacccttgttttcctttaggaatgtctgtatttctggtataatgaaggtatcaaatccaaggagagaacgatggcttccagtgcaaaagacatccagcttttagagctgaaggacactataacacaactgaaaacaatgatctctgagcagacggaactgatcaggtctctccgtcttgttattgacgaaaaaaccagccacgaaaaagcccttcaggaacaggtggactatctgaccaaaaagcttttcggttcctccagcgaaaaaagaaccgatgacattccagggcagcagaacctttttgatgaagcggaagtggaacaggatccttccatgttggaagaagagaccgtgatccgggagcatacccgcaagaagaaagcaacccatgaggatctttttaaaggcctgaaggttgaaaaagcagtcatccctcttccggaagaagagcaggtctgcccggtctgcggtacgcagatggttctgatcggcgaagagtatgtccgccgtgagctggaattcattccggccacatgtaaagtgatcgaatactacagccagagttatggatgtccgtcctgtaaggaaggactgggagacacggaaaaacctgtgattataaagtcccaggttccacaggccctggtaggaaaaggcccggcgaccgcatccaccgttgcatggacaatgtatcagaagtacgcgaatggacttcccctgtaccgccaggagaaagactggaaacagtatggtgcccagatcagcaggacgacacttgccaactggatcatctattgctccgggaattactttcagccaatgtatgattactttcaccgggaactgctgaagcgcagcttcgcaatggcagatgagacccgagtccaggtactgaaggaagaagaacgccgggcacagacgcaatccttcatgtggctgttccgcagcggcgaagacggccttcctgccattattttatatggctattcaccaaccaggagcggcagccatgcaaaggaatttctggaaggctatcatgggtatctggaaacggatggttatcagggctacaacagcctgccggatatcaaacgatgttcctgctgggcacacatccgccggtactttatcgacgccgttcccaaagggaaaccgtatgattacagccagcctgcagtacagggagtccagtactgtaaccgcctgtttgccatagaggattccattaacaaaaaatatcccggtgattatgaaaaacggaagcagctgcgtctcgagaaggaaaaacctgttctggaggctttttggttgtggcttgagcagcagaagccagtccggaatacccgcatggataaagcggtgaattatgtccttaaccggcggaaaacagcggagacttatctggaggatggccgctgtagtttcacaaacaatctgagcgaaaacgcgatccgtccatttgcagtcggccggaagaactggctgttcagtgattctgtctccggagccaatgccagtgctgtagtttatacaatggttgagatggcaaaggcgcacgacctgaacatttacggatatctgaagtttctgctggagcaccggccaacgaaagagatgaccgatgcccagctcgcagagcttgcaccctggagtgaaaaactccaatctatcaaaaatcgcatgtgaattatagtgaattactccaactcgcaaagggctggggtaattttatatctgaccgcatcattatttggcggttacggtggaacaatcaaagaaatgatggaagcagaaatggaggatcatctgggatatgaaaaatctgaacgctctgataacgaggattaccgaaatggctacaaacgcaaacgcgtaaacagcagttatggcaccatggagattgaggtccctcaggattgcagatccacttttcagcctcaggtcgtaaaaaaacgtcagaaagatatttcagatattgatcagaagatcatttctatgtacgccaaagggatgaccaccagacagatttctgaaacgatcgaagatatttacggctttgaaacttcggaaggatttatttctgatgtaacagataagatccttcctcagatcgaagactggcagaaccgccacttagatgaagtatatccgatcctttttatcgatgcgatccactattctgtccaggataacggagtgatccgcaaactagcggcatatgtgatcctggggatcaatacggaaggaaaaaaggaagtccttaccattcaggctggagataatgaaagctctaaatattggctttctgttctgggtgtaaaagacatcctgatcctttgtgccgacgggctggccgggatcaaagaagccatcgcggctgccttccccaaaatagaatatcaacgctgtattgtccatcaagtaagaaataccctgaaatatgttccggataaatacaggaaggcttttgcagcggatctgaagacaatctatcaggcgccagacgaaaagaaagctctggcagcccttgagagggtaacagagaaaagacaccaaaatatccgaattccatgaaacgctggaaggataactgggattctatttctccgatcttcaagttttcagcagatgtccggaaggtcatatacacgaccaatgccatagaatccctgaattccacgtatcggaaattaaaccagcagagaagcgtatttccgagcgatacagcgctgctgaaagccctgtatctggccacttttgaagcaacaaaaaggtggactaccaccatccggaactggggccaggtctacggtgaactatgccttcattttcagaagccccttataggttacgtccgtttccaacaataaattgttttttccctcagtgcttcgcttcatactattaatatcaaaaatttgtcccttaacacaaatctatatcagccccaagtctacaaccaccttgacagagttccttgcgaacgcagttagtacatttttcttttttccactttctaaatgcagtaaattttttgccccaccaaatttcccgtaatgttttacacttcatcgactcagatatgcttttatcccatataccaaatgagcacggatagcaattcatttgactatctatatacatggaaaaagttgcagcctcacaagcatctatgctagcttttggcacagtatctgcccatcgcagtattgccggtgtaaaacatgtatcaaagccaactctgtaaggatgttttcgcttcgttacaagagaaaaaaaattttcatttctttcatccgtatgctccaatattttttcaacaataccattacctacaggtttatacaaaataaacacaactgcgttgacctcttgaggaaacaaatcattctctaatcttataattgcttcatcaatagtgtcttttgacacaacgtaatgaatattggtcgtacatccgcttttaattaatcgctctacagcttttatcgtttcttggttactttctcttccatctattaaacgagaataccaagatactgcaactgctccacaatattttttcatcaatttaacttctttgtctgtcatagaaaagccgcttgttgtcatattaggaacaattctatatgctctacaagcttttaatatatcctctaattgaggatgtttattaggatctccagcccctcccaatgcaatttgaaacgtcttgcctgttgattgttctacaatttcaagaaaattctgatatgacatatgcggagcatgtactgtataacctctttgataacaatcaattcctgctcgtgtacaatattcaccactaacacaatgccccataattcccacatcaagtaattccggatatgatctcattacgggatcaattccatctatatcacttcgaaataaagtgccgttttcttcgttaaaaatttcaaaaaaattaaatacttcatctttataaataatcatttctaccacacacaagctctaccattaagataaaaatccttgtcctctatttcaaaactatctgtagtaaaaaactgtgttatcggtgaatcatcactacttgtatatccccagtatgtatgataaccttcttttatttcaaatatcattgctgatttatcgccgaaaacttcttttattgattcataggtaggtgtgtcatagtcataataccgtaaaccgccattaatagcatccataatactactacataattgtcgcccttgttcttccagcacgcccccctgaacaaaacctagtttattaaataaataatcttccgttaattcatcttttgatataataaggaaattcgtagaagaactattcgtaataaaccccatccttatcttcatcttccaatcctcctactgcttttgaaaaagcatttttaaaatactcatcataattgagcgtttctatatttctttcaatggaacgacgcgagcactctttcatggaataattaccttcagccaactttttagcattgtcacattcaatattaaaatgttcttctataaatttttctagagaacaaaattcctttcggtaatacttcctatattcccttctaaagttgattgcaccttgaaaataataatcatacattctagaaatcatatttcccgcaaacttttttttctttactcccagagttttcattactttctttttagatggtatatccttttgacggaagtaaattctcccatttgccttataacatgatgcttcattcataatcacttacctctaaaccacaagcttctctcatttttaacttcatctcactttgaaccttatcatgtgtaggtaaattgtagaaaaagtcttcgagttcttcctgtacctctacatcatataattcaaaacacaacagatataattcagcaatcttttgaatctgcaattgttttcccgaatcatccaacgcaatataatattggatgaaatcttctggaataaaacgatcatccctactattacgtgcatcaatcttatgaaatacattaaggattacatctttattttttaatccaaacaagatgtctaaatacatatcaagattgtatataccgccataaagtgttccatctaacattatatcaaacaatattccaccatcttcatatggatctttccttaaacaatctcgaatatatgtaatttcaaaatcagccaattcaataccagatgttaagataattcttaatcccagattttgaagttcttccctgtgatgcatgtgccaatatgacttcttttctctatcttctggaatacgatataaattaagaattgaactacatatttcatccgtctggcctgattttgcaacaattttatcagttctaaaaaagacataacaataatgaataaccccttctgcacatgatgcccccattgcttttaactgtcttaacttttccagaaccgcttccccatttacattgtctactaacatattcctcagcaagattcgtcttgccagataataatctctcatctcatcaaaaacaaaatatactacttcatgttcatttctggcgattgtcccttcataaaaaaccaacttcttactgagtagaatactgctgtctattgtttcctttatcacatctggattaactcctacgttttccaaatcaattaaattaatctcatcatatttctcattttctatcatgaaatctgccactgcattaagtacctttacgatattatcaccactattcttccttattacttcaatatactgagcatatatttcatgttttcgaattgaatatacatctacattacttccattattcacttcaaaaaatattcgcaacaacaataattgctcactgagtacattacgtacagtaggagaaatatttccactataattaaaatatttactatatgccttaataatctgattaatcgcagcaagcgtataatgttgctcctttaagtcaaattcaaatgctggtatatcaacattttcaacaagatgttttctaaaacgttctttataatactcatttctacaagacacaataatatttatcctactatatttagtaattttattaataaattcagcgatattgctgccaaacccattgctatcattttcatttattgcatcaacaattataaaaagaagtttatgctgaatagtcagcagaaaatttaccagagaaagatacatatttttatgcttcttatatatatatgggagttttaattcacagaataaaaacgataaaacatctccctcaatatccctagcatttaaaaatataatgggttccttaaggttcatcaataattcactaatactacatagtaaatttgttttaccatttcctgcactaccagtaaggataaaatacttcctattagcagccttactacattggtatacgttccttaatatatcagtataaggatattgcgatatttcaaaaagaaattgtgattctttatagtccgacttgaactccactttagacctattgaaattattatgtaaattaaatgccgatttcgttgctttttcaattttttctaacgaagttttcctactaagcttatagcatacatttggattcttatatgcttttctcaaaatctcaccataagcattatcatatacaaagttaaaattttgaactaatcgttttttccatctctttctataaataaaatacctcaatacctctttgctgtcatttaactctacaaaaacgcctggaatatattttctgtctttaatcaagcgattaatctgcttattggtaaacttattagcctttctccgaattgagaaaagtgaaactataagaacaagtaccgtaaatataagtataacaagccaccataagttctgaatggtatcacttaatccactaagaaaatcgattacagaagaacaggataacgtatcttcatgtttagatattggtgcagatgaaagatgcttatctgcttgcattattatatccattttaatctccattccgccgccaagcggcggcacaaatagtaatgaaagtattccaacttctactctttggtgtaaaatagcttgtgagaagctacactacaaagcacgggaggagaagttgtaataactttcttcgttttagacagcataataatcagtgtaagttctgccttttcaagcacaaataagtggtactatgagtccgcacactaagaattgtttaagcgccttagtttaattgtgtggcagttcagtcaatggcctctcttcttttacgaaaggagtctgacttatgaaagttgtttatcaaacctgttgtggtgtcgatgttcacaaatcttttctcgttgccacaattattaaaacctctggcggaattgagccttcttatcaaaaaaagcggttttctacctttaacaattctattcttgaattcaagcactggcttctcgacaataactgcaaggatgtctgtatggaatccaccggtaaatattggatccctgtctttaaccttttagaagacgaaataaacgtcaccatcgctaaccctaaatgggtaaaagctgtcaaaggcaataaagatgatacgaaagattccaaatggattggtgacttgttccgtcttggacttgtgagaggcagttatgttccttgtaagaccatccgtattttacgtgaatatactcggtatcgctacaaacttgtttcctgccgtaccagtgaaaagaacagatatcagaatgcgctcactgtctgtaatgtcgcattagattcagtagtttccgatatcttcgggaaatcatccacatccattattgactacctgcttgaacagtccggtcactctattaaccacgaagaaatcgcatcaaaacttcttagacgtctcaaatctaaaacagatgccgttatagaatccatcgagggatatcagatgactgatgcccaaaaataccgtatgcgcctcgtccgcgcacatatggattatatcacagccgaaatcactgatatagactctatgatagaaaatctgatttcttctgatcctgattatgaaaatactgttcagttactctgtaccattccgggtgtaaaacatgacagtgcaatcactatcatctccgaaatcggtattgatatgactcagttctgtacctcaaagcgtttatgctgctgggccggattaactccggggagcaacgaatctgggggtaagaagaaatctgttcgcattactcgtgctggtgtctacctcaaacctgcattagtacaatgcgctcatgcggccgtgaaatccgaccaatctccttactacaaaaagaaatatgaatctcttgtaaaacgtcgtggtaaaaaacgtgccattattgctatcgcccggatgattctcactgctatctatcagatgttatctactggggaaacatggaatccgaccgatttatttaaaattgatatgcctgaggttttgcttgaaaagcaaaaacaaaaggctatcaaacaagcgcagaagttactgatacgcgaagggttattacctccattggaacccctggcttcctaaactaattatctgatctatacttttttacaggttaccatttctggtagcttattaaagtacgtcactttttggctatcctctactttctttcacactaatatccctcctccttagttataaattctttctcctctatagcacctactctaaataaccccaaaatatctcaaggcatctttgattgcttctactttttctggtgttggatgcttcctcggctgtttcaattcctctaccgcatttggagcatcgtacatcggcaaacctaatttcctctttacctctgcaatatatgcggtatgtactttgaagccatatttcgcttctatgtactcctgtatcatcttgtaagtaactcgctctttcggcttgtaggcttctgctctcttagcaatatcatcaagcggtactttgccctctccctcgccaaactccacttttacgctgattgtgctgtcaggctttttgtgggaaagcagtaccaccgtctccacatgcggtaagatagatattttatactacatagcaaaaggatattcattacagaatagttgggtatatattctcgtcaattttacttctcataccccttttgaacaaaaatcacccctttatgaataaatttatttctttaatccccctaccataaaaataacacttttttaagtaaagtcattttgatctttcattgtcatattcccgtgcctcatattcccatttaaaacccttttatatggtaatgtagaattgccccgtttatataaatacttgtcgcgacgcctgaatcatttgtccgaaattctgaaagtcaattatctctttagtaccatcaataatacaatcaacatattcaccaaagtcaactaacttggtattattagaaggaagaatcatcagaaatagctgcgttgatataggaaaaaaaataaaattattgctatctgtaatataattatcttcaattttatatgattttagcttttcattatatagaacaactggattatcacttgtaaaaatttttttatcataaagtttagatctaattaaaatccaatttctatctattaatatttgacaagaaatatttaatataatttcgtggtttgctaattcaagatattgatttttagcaaatgcctctaaccctgttttagaaatataagtttctcctgttctctcttttaacaaatctaacttttcttttgtattttttaaaataagcggaatcttaggactaaaagaattataactatgccttctccacttttctgttcgaaagagttgtgtaataataatttttgacatcttatttttaacttcatccactaaaattttctctgtagattttaacttagtacttttatttatgattttctcaaatgtttctggcaaactattttctacattcatagaataaaactcttcccaaattaactcattacttcttaaataatctcgataaaaatctctcctaacagctaaatctttaggagacgcataatattcacaaattttcaatttatcaaacaccttaattttaccactatcattaacaaaatattttaaatagcactggggaacaatatgatgtcttctcggtatattattcacttatatctccttaattacaaatattaaactattcttctctataaatatatctaatttcacgcacatcttttccgccaatgttatcatctaaataagcatcagtcattataaatcactctttttcataaaattttcttgctcccagattttcttcaagaaccccaaaaaaaatatttctataacccattttcttcaactcgacaataactgagtcagaaagggctttaccaaaacctctgcccatatagtccggtaataaataaatagaaataatttctgcccacccgctaaactgactaaaacgtgattcacaaaaactacttgtgcccacaatccttccgttatcaacacaaaccagcgtactccaatttgagttttctaaattcgcaccccagcggccttctggaattgactcaagataatcttgtggtattaaacctttatacgtatatttccagctttcttcatatatcctgctgattaccataatgtcatcagcaggcgtaatatactggatttccactaagctcacctccgcaactccccatgttttctataagtccagtttactacacttaaggttaaccgtccataataagaggagtatttggaatttggtatgtgagagaaatgtccggccatggtattgctacagagtatatcttttgccagacggtatccacttttgccaaatagtatgggttctgccggattgtatcttttgcccgacaaaaccctcattttcaaactctccggcgttatccccgtccccctatctgcggaaacttattcatctcaccatccgcaaaaacacaactccattttctccaaataatcccgcaaacccgcctagaatcaaggtttccgggttagcaacgccactgtctccacgtgaaccgtctgactaaactgatccacacaacaccccctctccacccgatacccctccctcaaaaacgtctccaaatccctggccaagctggtaggcttacaagagatatacaccatcttatccaccccataccccacaatcttcggcagcgccttcggatggattccatcccttggcggatccagcacaatgaaatccggcctttcctcaatctcgtcaatcaccttcagaacatctcctgcaataaacctgcagtttgtgattccattcatctttgcattctctttcgcggcctgcacagcctcctccacgatttcaaccccgatcacctctttcgccaccggcgaaagaatctgtgagattgtcccggttccgctgtacagatcaaatacagtcatgtcctttgtatctccaatatattccctggccgtattataaagcacctctgccccataagaattcggctgaaaaaatgaaaagggagtcactttaaacttcagccccagaatctcctcatagaaataatccttcccgtacaagatccgtgtctcatcactctgcaccatgtctgaaagtgcatcatttataatatgaaggaatcccacaatctccccttccaaaggcagcaccaacagttcttccttcagcggttccagatcataatcctcctggcttgtagtaaccagattcaccaaaatctccccggttgtattggcccttctcaaaagtaaatgcctcagatatcccacatgctgcatctttttataaaagctcacacccctgctcctgaaatactcccccacacaccgcaggattttcgtcatatcctcatgcaccagtttacagtcacatgcattcagtacatcgtaagtgctccccttcttatgcagtcccagtgccagcggtccatctttatattcatcgccaaaggaaaactccatcttattcctgtatgcaaactccataggacttcccttgatgccctcaaacacataatcaggattcccgtctgcgtccacctgcccagcatctgcaatggccttgtccagcagattttttatctgctctgctttcattttcagctgatctttatactccattgtctgatacatacagcctccgcagtccggaaaaatactgcacactggttcccgcttttccagaggagatttttccagcacctccaagagccttccctccaggcgatctcctctctttttgttgatcaaaaacctcaccttctgccccggaataccattttttacagtcacagtctttccctctgctacaacacgccccttattggggaagtctactttttcaataattccttcgtaaatttctccttttttcaaaactattcctcccgataatatttaacagaaaaagaagctccggtttcccgaagctccctattactcttttttatttgtcttcatcctcgtcatcgtcttcaaaataatcatcgaagtcatcgtcgaagtcctcttcaaaatcttccagataatccggagtgaagaaacggtatactgcatatgctattccggcaacagcagctactgctccgatgatagccagaatccataagacggtattcttatttttttcttcttcttttttctgtaatgctgtgattaaatcctcaatacgattcatagcctgcaccatcctctcttactatgacatcctgcactgctgccccgttatccggagttgctgccggctgtctgtcaatcttggccgaatatgtttcaaatttctttattatagtatcctgtaaaaaaactttcattcggcttgtttttaatattatatcacgataggcaaaattttactatcctttattcaatattttcatattgatttgcagtaactgatcacggatcactgttcacatactaccattctaatagacggtttccaaaatattccccaaaggagtaccgctcgaagcgcagaaaaatactaagttcacccacgcccaaatgcaattttctgcattttgcatccttaaaggtctgattttccttaaaaggcgaatctatcttaaaggacgaatctacctaataggcagaactgggcttcacaaaacgcatcactgttcacaacacaaaaagtaacttagctgttccgtcattctgctcctttactgcactgtccgcagaaaatccttcaaaccccaacaaaaccccattgccaaaaacgaattcacatggatctttatacctatccataaagctgctgaacagttatgatttacttccttcatatatttccattccgtacctgtgaactgaccggccacggaattcgtcatagagccaatctcaactctattctcagctctatttcttatcagcttctgcagatttctcaaatcctattccacttttttcagttttgcaaaggaggcgaacattttcttagttcccgacttgtcaaaatccaccgtgacctcatagtcacggccgccttctacaatacctttcacaacacccacaccaaatttgatatgcttcaccgtatcgcccacatcataggacagccccgcagacttcttcacctcaaactgttttggtatgaatgccggctgcttaaatgcctgcttcatctgcttcatagtattcggaagtggaatctctttgatcttctgctccttaaaatctctgcccagatctactagttctcttgggatctccctgataaaacgggacggcttgttgtactgtgtctccccgcggatcatcctctgctgcgcacaggtcagcgtcaaatccttcatagcccttgtgattcccacataacaaagcctgcgttcctcttccagctctgccggatcatccgcagtgatggtcatataacttgggaagattccgtcctccatacctgccagatatacataaggaaattccagtcccttagcgctgtgaagcgtcatcaaaagtacctggttgccatctccgtccacagtatcaatatccgcgatcaatgcaacctcttccagaaatccactgagtgtaggatcctcattctcctcttcataggaaacgatcttggtgatcaactcgtcaatattttcaatccttgcgtccgcttcctctgtgccctctgcctttaattccatcacatatccggtctcttcaatgatatcattgagcagttcagagggagaataatactctgtcttgcttctgaggctctggataaatgtgacaaaaggctcaatttttgccgctgccctgccaagtgtggaaatattctccgcctctttcagtgcattataaaagctcatgtcatgctcagtcgcataatcctgcacctttgtcagggtagtcgctccgatcccgcgcttcggcacattgatgatacggcgtacagccaggtcatctctggcattgtccacagtcttcaggtaagccagcaaatccttgatctcctttctggcatagaagttgacacctcccaccagcttataaggaatattagccatcaggaatttctcctcaaacagacgtgactgggcattggttctgtacagaatcgcacagtccttatactggcagtccgcttcccgtactttcctgctgatatctcccgcaatgaattccgcttcctcatatgcattcatgaactgcctgtaatgcacaagggacccttcctcattgtctgtccatagagatttctcttttcttcctatattattatgtatcacctcattggcggaattaagaatattctgggtggaacggtaattctgctccaacttgatcaccttggcatcagaaaataccttctcaaacccaaggatatttccgatatttgcacctctgaatttatagatggactggtcatcatcacccactacacatagattcttatatttgctcgccagaagacttacaaatttaaactgcgccgtattggtatcctgatactcatctaccataatatagcggaaacgttcctggtaataatccagcacatccgggcaggcctggaacagctccactgtcttaacgatcagatcatcaaaatcaagggcgttattttttctcagctccttctggtattctttataagcctgggctatttttttcttgctgaagtctgacatattattcagctcatattcctcaggagtcaccaactcatcttttgcagaggaaatggcagagaggattgccctctccttatgtaccttcgtgtcaatctgcagacgtttacagatatctttcatcagacttttctggtcatctgtatcataaattgtaaaattatggtcaaagcccagcctgtcaatgtatcttctcagaatacgcacacagcttgaatgaaatgtagaaacccatatactctctgcgccgaatccaacaattttatccacacgttcacgcatctcgcctgctgccttgttggtaaaggtgattgccatgatattccacggattcactcccttttcctcgatcagataggcgatcctgtgagtcagcacccttgtttttcctgatcctgctcctgccaggataagcaccggcccctctgtatgaaggacagcttccttctgctggggattcaatgtgtcatatatactcataaaaatgtccctccataattaaagccataaaaagcacactttgcggactttctatggttacgaataaaaagcacactgtcacagttcatagacctgcactttcggcagggctgtgaacagcagcagcatactctgtactttctgtctccaggtatcaaaacacctgttcctacaatataacacagctcccctgggcaggcaagcatttgcccgggatttctgtggttttcagaaaaatccatttacaaatagtattaaaaactatataatagggcgtagaggtgatgagatgacaattgatactaaagatatgctgaatagtattttggccagcatttcccgcattgattatattaaacccgaggagattccgggcattgatttatatatggatcaggtaactacttttatggagagccacctgtccgcatccaagcgccacgcggatgacaagatcctgaccaagactatgataaacaactatgccaagaacgatcttctcccgccgccggtgaagaagaaatatacaaaagaacacttactgatgttgacctttatttactattttaaaaacattctgtccatcagcgatatccaggtacttctcggcccgctcacggaaaagtatttcaataaggacggggagatgaacctgacagaaatttatgaggaaatcatgcgcctggagttaaagcagatcgatccgctgacaaaagatattgtccgcaaatacaaaatggcctgtgattcctatgaaaatgcagaagaagaaaaccaggatttcctgaagaaattcgcatttatctgcatgctcagctttgacgtatatgttaaaaagcaagtgattgaaaaattgattgacgatatggcggattcccataaataataccccaatcttaacaatataaaatgctgtccagggcaatactcccccggacagcattttatattatatgataaccttggtcagtgcagtaaatgtgcggacctgctgcatagctacattatggcagtccatatacattcatttatacggtacccggttaccggcacaacagcttttctcagcaaaccaggcaagacccgtaatcccacagcaggtatcattctttttttccataaaccgcgtgtttcggacagttggtgatacaaaggccgcatttgatacacttactcccgtcaatccggaaggactgttttttcaccccttctatcgcgtctgccggacagttcctctggcatttggaacagccgatacactcagattcttcgatccagacttttgcccacttttctcccgactgtatattttctgacgtctgttccttctctgccctctgttccttctctgccatctgcgttttctcttccgtctgtgcctttacttccccctgttccggtgtaatcacagcaaccgggcactcattcacgcacgcaccgcactccacgcagttgtcaggattgataatgcagttatgttcttccactacaatctcaactgccccgaactcacaggcctggtaacacgcctcacatcctacgcaaaaataagtatcaattttatatgccataatttatctccatagaatatttgatattacgatttggctatttcttattctttgtaaagattgccttgatctttgcaaacgtcttagaagtctctgccgcaggctcacccgaatccggcgcgtccgcaaccacatcctcatacagatacctgccccggtcatccttcggcctttttgccatgtatttcaaaaatcccacaataaccagccagcctacaatgatgatagggaaacctgcaaatgtcttaacgaacttaatgccgtcaataccgcctgtcagagtgaataccagggatgccagtgcaatgataacaccccagatcagtttcagccagaaaggtgcttcttccgattctgagctttctttgagtgtcatactggaaatggtggagatcatggaatttgccagtgtgacaaaggaaatggcaatgatcaaaagcataaagggacgtatgatccctgaaaacggtacatgctcaaatacggctaaggtcatggcctccgcgcctttttgctgatagagtccataataatcaattccctgatacatctgtccgtacagaacagttccgccaaaaattgagaaccaaacgataccgaaggcagaaggcataacccagttgacaaatacgaattctttcagagtacgtccatagccaaggcgtaccagaaacagtcccatgatagcgccatagcacagccagtcaacccaccaatacatatcccaccactgcggccagagctggctgtctgcaaaaggtgctgtaaatgtcatggactccacaaaatgattcacataggaaccgatagactgggtaaacagattaccgatataagtcccgggacctacaaccagaaggaacaccagcataaagataaaaaaccatgagttcttatctcccagccaaaggatacctttattcagcccactgatactcgttgcggtataagccaggaagatcacgaatgcgatcaaaatatacaatatgacatttgtgtcaattccgaacactacggaaataccgctgcccagctggaggattccatagccgagagatccggccacaccgccgacgagagcaaataccgtcaatacatccacgattccgccgaatttacttttcaggatcctgtcgccaaagagcggaaccagtcctgaactcacattgaacggtttgcgcatgttgtagatcacatatgccataacgatgccgaaggcaacatagatggcgtatggtgtcaatgtccagtgaagaaatgtagttctcatagcccagatcacggcctcgttgcttcccgcttccagaccaagactgggagccggctccatagtaaacagaagcggctccacagctccccagaaaacaacgcccgttccgatcccggctgtcagcgccactgcaaaccactgccaataagtcatctttggctttgcattcggtcctccaagcctgatctttcccattgggccaaacatgaccaccagacaaaagacaatgaacaacagcatggtaatactgacaaaccatccaaaaccggacatcattgtctcaaaagcactggtcaaaacttttataaaagtagtaccgtccaaaatacccaatatgataactacgagaaaaattgcggtaggaaccagcagcaccgccggcctgatttttatcttattcttcatagtaattcttccctcttctttcttaattccactgttctggtatatcaaagaatatggcctctattccgtgactgttcagtatccacaattacaggatatgatctagccgtataagtccgtgataacttcatccatatgtcctatccattccagcgcctctttatatggtttgccgtccatgtttatccacatggcttcataaaagctgtcgatagcctggttcacatcatgggtcacacccgcatttgcccctgttttaaggggcggttttcccaggattctgtcactccacttaaagtcaccacgtttccagccctctctgacattaaaggcatttctcatatggaagatacgcattccaaccagatgtttttctatgggtgtatattgaaatccagtaatagcttcaaggtagtcccacttcaggtttgcgatagccgtatcatacatatgacagtagccgcagctctcagaaaacatattatcggatttctgcttcgcatctgtaaatccaagtccccgctgattataccgtatctccggtgcctgtccgcgcagagaacctcccagaggacttttcatatggcgccccggtgtgggttctaccgccccttctgccaaataccagggggaatttcggggatcgtgcattgccgactcaatacctccaatggtaaacagacactcatggccccctccgatgagatcagcggcatactgtgtgccgtttctgagaatccttgccgcctctccggtattttcacagattgcctccgcaactgcttccattgcctccgggtcaccccatttgaagtcaattccgttaagctgctcttttgtcagtattcccttctcgtaacactcacaggcccatgataatgtgtccacaaatgtgatactgtcaaatccgtattcatttgtcagatagttgacatatacgactgcatctctgtctgagttaagcatattggagctgagacctgcctgggattcatattcaggacggctggcaccgtgcctgggaagctttccttttggatcgtcaatctcatattttgccccgcagcccaggggacagcagtggcagacatatcttgtcactttataccccgcttcataggcaggctcatatatggcatcccctttctccaggggataatcagcctcataggtactgctccaattcttcactcctgcatcgtcgataaggagcatggccttcatctggcctgcggtaccgtaattgccccattcccgaatatccttgttggcaccgtgcagcatatcctcggcaacctgtctgttgagggcaaccagcctttctttgtcaaagatcggaacttcctgtgatccccgtaccaccacggcttttaatttctttgagcccataacggcgcctgagcctccgcgccctgccgctctgtgctcatcattcatgacgcaggccatataactcatacgctctcctgccggcccgatgatggccgcattcatgtcatctcctacctcagcccgcagaagtgtctctgtctcaatggtacgttttccccagagatgggaagcatccctgatttctacctttccgtcattcagatataaataaacaggtttttctgagattcccttcacaaaaacgccgtcaaatccggaatgtctgagttttgcgccaaaatatccccctgaatttgcatcattccacattcctgttaccggagacttggataccaccatgtatctgcctccaaaaaacgctcttgatgcactcatgggacctgacagaaatccgatcatactctcgggtgcaaatacatctgtatgcgcaggcatctcgtcgtataaaattttcgccccgattccatagccgcctataaagtttctggccagctcctctgtcagttcacgtatctcgtaagtgccgttgctcaggtctacaaaaagcagttttcccatatagccatacagcatggttcaagtccctccttctactatttccgtactctgtctgattctttgatctgagtacgctctttctgccgcttcatcctccgagaagcgttttcattataatgagtctgtcaccgtccttcagctcatcatgtggttttatatgttttgagttacagatcagcatatgtgtgtcaagcacctcccgggctgtcagttctcccgtcaggcctttttcttccagcttttccactgcgtctgacgcagcggccccttgttccagctccaaccggcagtcccctgtggtcctgggaatgataatactctccatgattatggtaatggtcatctgtctcctcctttccgtccatctcagacggccaaaattctgaatcagatctacacggttcctgattcagatccgcgcggctcccgactcatatgccgcctgtttcactgccgctgccacagcgtctctgactctggtgtcaaatgcagcgggaatgatatactccgcgctcagttcctcatcactgatcagcgctgccagcgcatgtgccgctgctattttcatctcatcattgatatcccttgccctagcgtccagcgcgccccggaaaatgccgggaaaagccagcacattgttgatctggttgggatagtcacttctcccggtagcgatcactgccgctcctcctgctttggcgtcttcaggaaaaatctccggtgtgggattggcacaggcaaatattactgcgtcccggttcatagtcctcaccatatctgttgtcagggaacccggcgcggaaactccgataaagacatctgcgcctttgatgatctcttctaagcttcctgataatttatcccggttggtgatacgcgcgatttcttccttgacgggattcatattttccttccgtccctcatagaccgcgccttttctgtcacagaggacgatattcttaagccctgccgagatcagcagctttgtgatggcgattgccgcagctccggctccgttgaccactgccctgatactgcccatctccttccctgtgaccttgactgcattcagaatccctgccaaggttatgaccgcagtgccgtgctgatcatcatggaaaatgggaatatcacatttttccttaagccttttctcaatttcaaagcagcgcggagccgctatatcttcaagatttactcccccgaaagaacctgccagcagcgcgactgtatttacgatctcatccacatccgtggagcggatgcagagagggacagcgtccactccgccaaaggctttgaaaagtacacatttcccctccatgaccggcatccccgcctccggcccgatatttccaaggccgagaaccgccgttccatctgtgactactgccactgtattccaccttctggtaagctcgaagcttttatttatgtccttctgtatttcaagacatggctgcgccacccccggtgtataagccagggaaagtgcctctctgctgtccacggcagccctgggggtaatctccagttttcccttccattcatagtgcttttttattgattcttgtgcatagtccatctccatcacatccttcatttcctgttttttggtaactgtccagtcccttcacagttactttttttgtactatatccaggagcatgcgccctgtccttgacacatctgtaagcatcagaggatccagaaaagtatctgcctcctcctgactcagacatccgctctcaaccgccgcgcactttaaggacagtcctttttcatgggcatactgcgcagcctccgtgccggtctgatatcctttaagcgctgagatgactgctgcagacgaaagagtatcctccgcttcttttcggcagtgctcttcgtttacttttatagtgtccacacattttcccgcaaaagttttcagcatatttggtatcatctgcatcagctttataagctccgttatcataacagcctcccagacatttagctcaagctctccgccttcggcggctgccgtaaccgcggcatctgtgccgatcgccagatacgcaaggacattcatggattcgggcagagccggatttacttttcctggcataatacttgaaccgttctgtacaggcgcaatgcgaatctcattgatccccgaccttggaccgctggacataaatctgatatcacgtgccatttttgaaatacctgtcataagagcttttacggcagatgacacttttacatacacatctgcgtactgcagtccgtcaaacagattcttttcctgtgccacctctgttcccatggtcctggtcagactctcaaacaccagcccggaagccccctcatacatgttaagtcctgtgcccacagcagtcgcccccagaggcaggattagacattcccgcattacggcatcaagggtttctgcctgtctttcaaggaaagagaccgacgccccaaaaaactgtccgaaagtgattggtaccgcatcctggatacaagtccttgatacctttaccgcatccctgtattcttccgcttttgccgcataggaatttttaagtacgttgacagaatctcttaccgctgtaaggttctgatgcatggccagtttgatagccgccggtatcacatcatttgtggactggcctttgttgacatgtgtattcggatgtattttttcatttcctttatgtccgatcagcagctcgttggctcttttggcgatcacttcatttatgttcatatgaatattgacgcatccgcccccgcagacaatatcagagggaaactctcctgacatctctccttgcataacctcctcagaggcttttataatactgtcggcagatttttcatctagtacgcccagacttttatgtgcctccgcataagcctttttaatagccgccatactgtagatgatctcaggataacactccagtttctctctggaagccagacatagttcgagagatctctgtgtctgggctccataatatttgtcatccggaacagtgatattccccaacaaatcatgctctatcattaacttttcacctccgaaataaagtgttgacaaacaaaacgacccaatgttagaattgcaataattgtaaatattccgtaggtctgcgcatttactgcattgaccgtaagaaaatcccctcgaagaaaacgttcaacagccagacaaaactcccatagtcagcagtaattctgcatacatctttgctggcagctgtcagggtactgaactgttaccgataattatgatcaaaaggaagtacaagatgaagaattcctcaaataacttacctactgacacgaaatcagatgcctttaaatataatatccaagtattggacagagccttaaagattttcgagaccattgccaggtcacgctctcctttatcgatccaggagctgcagaacgcaaccggtctgaaccgcacaaccatatggcgtatactctctaccatgatggacagtggttttctcacccagcttccgcagtcaaagcaatactgcctctcctgcaaggcctgcaatcttctcagtacatctgctgcaagttctatcgctcttatcgaatacgcaagaccggaaatgcagcgtctccggcaattcaccggtgaaacggttttactgcttctgccggaagccatcggttcccggacggtcctgcagcttgactcctttgaaaccatccgtttaaaagattacacaaatgaagtgactccgctgttcggcacctcaaccggtattgtccaattaagtgccctgaccgatgaggagatacaaaatgtcctcccggaaacacttccttcttatactgaattcacgcctaccagcaaggatgagcttctgaagcgtattcgcaagtgccgcaaaaacggatatgcctacatcataaacgaatataatcagggagataccggtgtttctgtccctatctatctggaatccaaactggcgggcatgctgaatatcgcgggacctaccatgcgttttacagaggaacgggtactggcatgtattccggaattaaagaaatccgcccttcagatatcacaagaactcacatcctgaatattgttagaagccgacagccatgtgccggcttctaatcttaagttcctatcgtcaaaaatgatcttgtgtggtctttacccacaactattctggtgctgaaccgttattaaaattcaatgatataacgtcccatatttttggcagcaggatcatggaaagcgtcaaatgcaatattgatatcctcaagattgatcttcttaataataaggctgtccagatcgtatttcccttccagataaagctgtgcgattttagggaaatcattgaaaggatttacatccccgtagaagctgcccttcagtatcttaccgactctgtggaagcttcctgccggaatctcaagtgtcccatctgccggatatgctccgatcaccacattcatagagccttttcttccgctcatccaggccattcttccaaccatggtatttcccgtacagtcaatggtatactccgctcccacgccttctgtaatttcacggatcgccgctggcacatcctttaccttcagtgtattgatggtatgggtagcgccgaatttctttgacagttccaggttttcatctttgatgtcacaggcaatgatggtgcctgcgccgctgagttttgcgccctggatggcgtttgttccgactccgcccactccaaagatggccacggatgaaccgggtgtcacctgcgcggcacgcactgcagcgccatatcctgtggcaacaccgcatccgatcatactggcctgtgccatgggcatctcttccggaagaggtacgcagctcatctggggaacaactgtgtactcggcaaatgtggagagtagactcatgtgataacaaggtcctccgtccatactcagtctgcttgttccgtcaagcagtgtaccgtcaaacataggaccaaatgcagtctcacagagattggtctttccggcacggcagaacgggcatgttccgcagtagggaacccagctcagggcaaccttatctccaaccttacaggtagtaacattggaaccgactttttccacgatacctgacccctcatgtccaagtacctggggaagcggtgttgtggggtcattgagtgtgttcagatcactgtgacatacagcagtagccagtattttcacaagtacctcatcagatttcggttcagcaagctcaacctctcttacctcaagcggttttcctacagcagtcataacagcagctttcatcttcattttgtgttcctcctttttatggtgttttttcccgggatcagcggctctgatttttgccttccgattccgcgtttattaaaatccctctcatttccattggaggtgatttcatacttagtccagttccccttctctgatcctctcaattgccttttcaaaaccgtattttttgaccagaagggcaagttttttgtatccgtatctttctttgtaatctacaaccacaggaatggatgccctggcgtacttcctgcttgtttcctcattaagctctattcctctgatacacagcctgtcaaacaattctgccgctctggagagcctcatgatattctgcagcagcaaaaatcccgccatgtcctcccacacattgagatgcatctctccctgtgccagcactccctggatcacgctgtcgttgcctcctatgagcatgtcacactggatcatcatctccgccatcaccggattaacttttcccggaaagaaggatgagccggcctgcactgcgggtattttccactctccaagccctgtctcaggtcctgaagccaaaagccgtacatcccttgcaaacttggcaagtatggaggagaaaactctgatatgtacagacaacacagacagatcttctgtatactgtgccgcctgataaggacttttcttccatgagaggggcagtcccgtcacctcacggagagcgtctataatatatgccctgtacccgtctggtgcaccggttcccgaaccgatcacggtccagcccaagtttactctgagcagagtgctctgataattttccaataactccaactgttccaacagagctgataaaaacccttccaaaacggctcccgcaggtacagacattccatcctgccaacaggttctggcaatggtcagataaggctgaaaagcttccgccttttctgccgttgtatcaatgatcacccggatcacttctttcagcctttcaacttctctatagaggcttaaacgcaaggctgtatggcacacatctgaagttgactgggacatattgacatcatccacaggctgtatcccccggcctgcaagggaggctatgacctcgttcacattcatattggtccctatgccgcctcctccgtggaaggcatccaccggaaactgttctgagtgatcctgctgcagaagcttgtcacatgcaaggcagattgcatccttcttctcccggcttaggtaccccgcacagcagtttgccgccgcacatgctctcttcacctgtatcagagctgtcaggtacgagggaaattctgaaatcctgacacctgaaaaactcatgtttttaagcgttaatcttgtttgttctccatataattcaaccatttaaaataccttcatcgcatctccgttgttcgtattacgaacttattatttgtataatgaacaattacacagtagcaaaaactgcatgaaatgacaataggaaaacggccttttattattctaatttctcatggtgaaacctttttaaaccgctgtattcccgtttttcgtcatacttttttggttatattgcataattatttttgaatttcagccatttcttccccgctttgccatattccaaaatcgaataactcctcattgacttttagggaatattttgttagattacctttataaataccgcatttcatctcccggcaatacttttttaggaggttgctcatggagaaaacaccaaatcaattcattccggtaacactgataaaaggatttttagaggcaggaaaatccacatacatcaacagtctttttaaaaacaaaaaaaaggatacaggcactattctcctcctgtccctggaggagggcgaagtttcctataacggttctgcgcttgaagaaaaaggggtagctctggtggaactggaagaggagtcctgtctgaaccgggataacctggagcggatatcctctctgtataacccgtccggtatcgtcatagaatgcaatgccatgtggaaaatgcctgagtttgagtttcctcggaactggcaggtcaccaaaaggatcgctgtgctgtgcggtcccacgcttggtctctatcttgacaatatgagatcctttatgggacccatgctgagccgctgtgaccggatcatcatcaacagatgtgaggatttacaaatgctcgctcctgtcaaatcaaagctgaggcctcttcttgacgatatttccgttgctgccatcgaatccggcggcagcagttatccttttgactccatacaagatctggtcccttattccctggacgcggaagtgatcgcagtcacacccgccagctacgtattctggttttatgactgtcaggatcatcaaagcagatacgagggcagacgggtttctctggatgcagacattaaaaaatcacccgttttaaaaacaggtgactttgcactgggaaagatcgccattacgtgctgtgaggcggatatgagttttctgggctatattgcccactatgattccatagattccttttcccagtatgacaatgtacacgcagaggcagtcataaattatacttttatgcagcagtataaaagagtaatgccctatctgcagatcacacacatggaactgtccgcccccgacaatcatgcaattactttttaaccacaagaggcctatatatgaaaatatcccagttacattacttcacaactgttgcgcaattagaaaatatatcaaaggcagcggaattactgcatatctcccagcccacattgtcaaaaaacattgcggcgctggagacagagctgatgaccccccttttcaaccgggactccaagcagctctcactcaatcctgccggaaaacgtttcctggtgagctgcaaccgcatactgcaggaatatgagtcagtagtaaatgacatccatcttctgaccacaggcgcaaacaccagaataaaaataggctgttatggctctatcgacagattctatgcctgtatttccgaattcaaaagtcttcaccccgaggcagagtattatctcaacagctccattgaaagcgaagaacatctggatatcaacgactttgatgtcctgatctatcccatggagccgcaatatgacaaatttaccagttatgattttggcacagatcactatttactggcggttcccgcctcccatgagctttccaggcacactgccctaagccttaaaatgctcaataaccttgattttgtttttcttcgcagcaagaaatcttttgtggaatatccgtacagagtatgtacggccctggctgtccagtgtgcctcccagtcatttacggagacccaggaaatgcacaggcagatgatcgcctccgggattgctgtaggtttcgtatctgaaaactgctctgatttttattcctctaaaaacatacggctgatcccactgctggatcaccggttttcccgcaaactccggatatgtttcaagcgtgataaacacctgacggattttggccgcagtttcagagacttcaccatagactatttctcgttgaagaagataactacatagagcgtggatttacagctttccgaaagaaaatcgcatgataagacaatgaaaaaaagacagccggagggtaaccacggctaaaaaggatggatttaaaatatggagacaccatttgaaagaaatgtccccgccgtcagccaagcagaacagttgctgctgtcacgcaaaaaggtactggtgatcggatgcggcggcctgggcggatatatgattgaatatcttactcgtctcgggatcggggatatcactgccgtcgacggagatgtatttgaaaccagcaacttaaaccgtcagttaaacagcacgccggcgttgattggttctagcaaggccgccgccgctgccgagcgggtaaaaaccatatctcccggaacgtgtattaccccggtccaggctttttttgatgaaaccaatgctgaggaacttatccaagatcaggatctggtcattgacgcgctggataatctgtcatcccgctttctgatggaggatgtctgtgaaaagcaaagagtcccctttgttcacggtgcaatattaggatggagcatgcagatcaccactggactgcccggcaaaagggtgctgcacaaaatctatggcacctcccaggagcagtcccggatcgatgcatcctgcaagaccagcctggccatgaccccggccgcatgtgcggcaatccaggccaccgaagctctgaagcttctcactggccatgaaccttccctcagcggcagacttctcatattcaacctaaaaacaatggaacagctcatgatcccggtagaatgatccgggatcatgagctgttgccatcgtcatttcgtatcttatcatatgcggcatttcccgcctgtctcccctctgccgcgacagtttccaccatagaatgcaccacattgcagttgccgcacatatgaagccagtccagttcacccagatgactgaccacagtccggtccgggcgcagtcctgccgcgatcagcaggctcctgcagggcatatcctcctctcttcctgtgaggagatttcttatttttacgcctgacagctgttcttctccgaacacttccgcaacagtggaggagcagataagaggaatattaagctctgctatacaggactgatttctcctcatgcctccgcatgaggttctctgttccactaaggcccgaatctctaccccttccacagccagttgtcttgccatgatcagtcccagatccccgcttcccaagatcacagccggccccttaggtatctgatgatagacattcatcaattcctgggcctgccctgctgtgaagatacctgttgtcggcctggttcccgctatgggaagtgcccccatgggaacttccaggcagccggctgccagaatgagctgctggaaactgatcttctgcagaccggaatatctgccggatatcacagccgttttttgggatgtcacctccaaaacagtggactccggcagaaacggaatctcttttggaaaatgttccgccatcctttctgcgtactccactcctgtcaactgtgctccgaatccccggtgagcgcactggagcaggattcctcccatagtttttctccgttcaaccagaagaatatttttacaacccgcctcatatgcggactttgccgcggcaattcctgccgctcctgcccccacgatcaaaatatcaacatgtctcatatctcatgcctcatctcccgctccttccaacaggtttgaaatcatccggctgcagcggctgccctggcactgccccataccggtgcccaccctgcgttttactccgtcaacggtcaccgctcctcggcggatcgcctccagtattttcccctttgaaatcccttcacactgacagatgatctccccatgatccggatctttttctgccagtaaaaccctggattcaaaatccagaccggacaggcgtgtaatggactttcggcgggcattaaaaccggaatttggcggtgcatccagatattctgccgtcttgagggcaatataccggccaagctggtcggcacaggtcagccccggagtctttatgcctatcaggctccaaaatccaggcccgggattttcgatcacaaaactgtcaatgcttttttcatcgggaacgatctctccattcagcacttccacccggtaaggatttggacggaccgcagcaaaggaacgtatcactccctctaattccaaatccggaaataaaaaggcggccgtacttcgcagccgttccaaggaggaggcatctgtggcatagaggcctccatgcagaggacgtttggatgaactgaggagtagatttccctccaccgcaggcactgctgtgattcctttccccctttcctctgactcatggaaaataatatgccctggaacctccatctgcctgtccatcactaaaaaatccgtcccgtccagaaacagccgcaccgagggtggaaacagcagttcctgtattttatcggccgaaacccctgcgcagtttaaaacagctctgcacgcaatgggttccctgtccgtctccatgatatatctcttcttttccttccggatttttaaaacacgtgtattcagccaggcctcacatccgttctgcactgcattttcgtacgcggcaatccccagctcccagggatttaccgtccctgtggaaggcgccaaaagagcggaagtcacttccggggccaggaacggttctaataccccagcttccccgccactgagcagacgtaatccgggcacaccgtttttcagaccctgctcatattttttccgcagcaccttgtcagctctgtttccaaagctcaccataagagagccgcatcgtttaaagggaacctccagttctctgcataaaagatgaaattccccattgccgcgcacggtcatagccgctttcaaactacccggtttgttgtcataacccggatagacaacagccgtatttgctcttgtgataccggtacagacatcattcttttcttctatcaacagtgcagagacctgccaccgggtcaggtttcttgcggcaaaacaccccagcacaccacccccgatgactactgcatctatctctctcatggtcaaaacacctctatgatctctcccggagcttccaccgtatatccgcccatggagaggagcttttccctgaaagcttcacttttcaaaacagcgatcatctgctgcacaataggcatatcccaggcacgttccggaatgatcagatcatattcctcaatacaaaccggcaggaaatccagatcataaagctttgcggcggaatagatacccatgccggcatccgctgaatcagcagcgatctgggccgcaacagaggtatgcgtcatctcctccctctcatatccatagacggcattggtatccaccccatttattttgcagaggaaatctgtcaggatccgcgtgccggaacctttctgacggttcacataccggatgccctttcccgctatatccgcaaagttttccaaccccagaggattaccttttcggatcatcagtccctgttgacgtcccacacagcgcaccagcttcacatccccttttggaaaatattttttcataaatgacagattataagtaccagtggcagtgtccaggagatgacaccctgccacgtgggcttcgccccggcggacagccatgattcctcccatactgcccacgtgggaggaactcatataagtggaaacattgtcccggtgcagcatatctgccagctcatccagcagtggatcatgactgccaatgaccacaagcgtatttttcagtttctctttccggctcagcagccggacccttacctctgaacctgcctcaaatccctctgtgccctgagcaacttccagaataccgtccgctttcataaaggacgacacaacaccgctgcctctactgagaggagaagccatcagtttattatccacatagcccattcgcaggcggacgaactcctcatatttcaaaccggaaatgacaggtcgggtcaataccgcttttgcatacagatgcggttctgcctgcaccttcagccactggtcgatcagaggttttagcagttcttcaatcacaatgatgccggataccggataccccggcactcccagtatgggtttgcagtccaggcaccccagaatagccggttttcccggtttcatggcaatgccgtgatacagcacttcccccagctcttggattactttttcagagtagtcttcccttcccgccgaggaacctgcgttgagaagaaccatatcacattcctcagccgctttcgcagtcatgtctctgatggcctcaaacttgtccggcacaatgggatatgttactgtccgggcgccccactggtctgccatggcagagaaaatggaagaattgaattccaggatatcacccggccttggatcagaacagggcaatatgatctcatcgcctgtggggatgatccctaccaccggtttccttatcacctcgatctccatcacgccgcctgcaatcatagcgccgatggcagaaggcgtcaccttcatataagacggcagtatcatttccccggcacagatatcctctccgatctggcggatgtgctgccacggagctgctgcagagtgaatggtgattgaactgtcctcatttttcacaatttcttccaccataatgactgcatcacagccgtcgggaatggggtcacctgtatccaccaccacatactgcccggcggtcagtgtaaccggtgtagtctccgtggccccgaaggaggcttctgcccgcagagccacgccgtccatagcgcttgccgcataatggggtgcacagataacagcataaacagcctttgcagtgaccctcccgcaggcctcctgaacaggtatacattctgtctttggggcaaaaccgtttttgatcagcaagttcagataatctctccgcgcctgtttaagcggcacatttgtcaaatatttaaatcccatctctttattctcccatatgtacatgcacttgtatttccgtccccttagggataccttcgcagtctctcgcaatgcagaaatagccgtcagctcccgccaaagtagtgatcagcccggattttccccggataggccgggcgatccacctgtcatctgttttttccagccggacacagtgatactgggcacgcccatgattggctgtgacactttcagaaatttgggcagtgaccgtataactgcccatttcccgccccataagtcttccgagcagaggcagcacaaataattttgccacaaaataagcggccacaggatgccccggaagacccacaagaggcttacaccccgcccgacccagtatggttggtttgccgggtttcatcgcaatgccatgtaacagcagagtacccatggactcaatgatccggcaggagatatccttgattcccacactgctgcctcctgacaacagcaccgcgtcacattcagcggcagccttctccataacagaagcaagtaccacctcatcatccttcatgatcccatagctgaccacctctgctccgaacgcggtcagcatggcctccagcataggactgttcacatcgcggatctgtcctgctttcggaacctcctttggcgggaccagttcatctcccgtggaaatgacacccacggtcagctttttcaccaccggaaccataacttgaccaatggcggccatggcccctatatcctgtgaggtgataacccgccctcttcgcaaaatgattttcccaggaaacacatcatctccccggaagatcatattttctcccggtgcggcaggtttcaaaataccgatggtaccgtcaccgtaatcctccgcatattcgatcatcaccacacaatccgccccttttggtatggctccgccggtgggcacggcacagcaggtttccggctgaagttcaaaatcagccccttcccccatcagcacttccctatcaagggacaaaatagccggaatcgcatcagaacagccgaaagtatcccttgcccgtactgcatatccgtctaccgtagagcggtcaaaatcaggtacatactcctttgcggcaatatcatctgccaggaccctgcccatggaatccaaaagagatactagctcagtcctgtctttgagaggtttgaactcctgttggatcagagacagaacctcttccggtgtttttacatgcagcatacaatatacctccccctgcaatggattaaaatcagatactcatttctatcagtcacttatttctatcagtctcacatttctatctctcaatcatttaccccaatcatgtcgaaactctctcacccattgttcttatcacgaacattttacacgtattatgaacatttttatcttaccagaaaatgctccaaaaatcaatataatacggcttgtttccagggtttttctcacatatcatccaacagaatctgaaaacagacaaaaattttatattgataatgcacaaaatctatgatatagtacattgcataaatgactgcctgtacaagaacggagtgaaatattacgacagtcccatatttttgttaagcggtggacgagcctcttttcaaaaccaaacgattcgcactatttttatgcactttggtattggattggctggtcattttttatctcaaaaatatggaggacaaactaatgaaaatgaaaagaatcccaatcctgctgacccttactcttgccctggcactttccacaggctgcggaaaggctgacgacacccagacaaaacccacagccgaaacaggatcagcgactgacgcagacagcagttcagcggccgatacagcagaagaaccagccgctgatacatctgacgacaaagctaatgaggaaaaaattgacacagtcatcctgaaagaggccgacgacaacatgctcaacacctataccgttatcgcggtaaattccgaagcgccctttgtggatgctgacaacaatcccgtctctgatgtttctgtcaatacacagggcgcagacgctctgacagaatggtttctcagtcaggaagctctggacatagccgatgaatacggcgtggcagactatggtgagcatttgttttatgtaaaagaggatgcccctgtctactccggggaaattgcccctgccacagaagacaataaggtgatccgtctctccaccactacttcagtaaatgactccgggcttctctcccatatgcttcccacatttgaggaaaaatatggctataccgtagaagttcagtccgcagggaccggtcaggccatcgcagcagccaaaaacggcaatgcagaccttattcttgtacacgccaaagtccaggaagaagcctttgtggaagaaggctttgcccgcacagttgaaggtttccagtcagaacgcaattccttcctctacaattattttgttctgtgtggtccctcttctgaccctgcaggagctgcctcctgtgaaagtgttctggacgcattcgccgccatcgcagatggcaagtacacgttcatctcccgcggtgacggttccggtacccatacaaaagagctgtctctatggccggagaaccttgggatcacagcagaaccggaatcctttgcggattatacagaatggtatatctcagcaaatgcaggtatgggtgcatgtcttgtcatggcagaggaaaaagaagcctatatcttaaccgataaagctaccttccttaccttctctgcaaacaacggcgagatcaacgctgagtgataactgttaaacatctatttgccgataggaggatatcacatggaattagaattactggaaaaaatgttaaatcgcagaagtgtaagaacctataacggagaagccatacctcgggaaaaactcgatctgatcatccaggcaggccttctggcgccatccggcagaggattaaaaccatgggaattcatcgtagtaaaagataaggccatgctgcagaaactgtcaaaggtcagaaaatccggctctggaatgttggagggcgcagactgtgccatcgtcgtcgtaggcgacccggctaagacggatgtatggacagaagactgctccatcgctatggcaaatatgcatttgatggcagattctatgggagtagggagctgctggatacagggaagactgagaatggcgtccgatgagaagacaacagaagaagccgtacgggaattgcttcactttccaaaggattataagctggaggcgatcctttccctcggaatgacagaaaaccatccccacccacatactatggatgagctttccacagaaaaagtacattttgaaaaattctgataactcctagacacacactagacaggtcagcgcatttactgcgctgaccgtaaaaacacgtataggaggacaataaccggaaaggacacaaaagatgcagtctgcatttgaaaaagcaattcaactgattctgagcgcagatgcggaactctgcaacatactttttatcacagccaagatgagtctcaccagttccatcattgcccttttgctgggtgtaccgctgggaatctggtttggtgcctgtcgttttcgcggcagaagtattctgctggtgctgaaccgtactttgatgggtatgccgcctgtggtctgcggacttttgttttatatgttattttccggtgtcggacctttccggcactggaaaattctttttaccgtaaatattatgataatcgcccaggtagtattgatcacacctattgtcatagggaatatggaaacctatatttccggaatcgcacctgccatcagggaaaccgccagcggacttgggcttggcggttttaagatttttttgctgctgaccaatgaatgtacttatcagattttttccttctatttattggcatttgcaagggcaatcgctgaagttggcgccgtttccatggtgggcggtgcaatatcgtggaaaaccaatgtaatgaccacagccatcatgcagtatatcaaccggggaaatttctccaaaggaatcgcactgggcatgatcctgcttaccatctcgctgatgatcaatattataatttctcttttacaaaggagattgagccgatgaagatctctgctttttctaaaacttatggcagtatgacagttcttaatatccctgaactgcattttcagcccgggaaaatctacagcattatcggacctaatggaagcggtaaatccacttttgccaaaattctggctggtacactcacagccgatcaaaaaaagaaaccgctggactcagccatctctgtggggtacctgccccagaaaacttatgcattccgtatgagcacccaatccaatatcctgctcggaaataaagacccaaaaagggcggagtatttaatgcgtgttctgcagatcagcggcctggcatcaaaacgggccaactgcctttccggcggtgaaactgcacggatggcgctggcccgattgatgatgaagcaattccatcttgttattctggatgaacccactgccgccatggatatggaggccacttttttgtcggaaaaattaattcaggaatacaccggagaaaccaattgtgctctggttctcataacccacagcctgcagcaggccaaaaggatcgcggatgaagtctatttctttcacaacggaaccctctgggaatccggccccaaggacaacatcctatctgcacctgcacgcccggaaaccagacagtttctggatttctacggcgcctaagccagaggtacttcctattctcttttcatcttatgtctgaacaccagcacagcagccgcatccaccaccaccgcatatgccaggacccacaacagttccggcatgatctttccgtattcccccgaaagcgcatacctgcccgcatctactgcatgcagaaatggcagactctttgccaattttccaaatgcacctccgaccatagccggatcgaaccatgtaccggaaagccatgcgcttaagttggtgagcagcgcaccgcaggcacctcccacctgtttatcattgaacacgctgccgcagagcaggccaataccgataaacaacagcgctgctggtatggaaaccaacactgtcagtagtatattcaagctggcagaaagtcccaggaacagtgccgtcacaaaacagatcagtatctgcaccactgccatggggatcagcggcagcgtatatcccgcaataaaatctccagcatccataggtgaggcaaaaagccgcatcataaaggagcttgatctgtcttttgcaatgatcatgccggaaaacagcgatataaacgacattccgaatacagcgataccaggggttaatttatccacatcaaataaatccacgggtgcatttgccccaattagggataaaagaagtaacaaaataacaggaaatccaataccaaatcccagagttgtcttatctctcaaaatttccttggcgttccgtgttgcaaatgccattgttttcatgataaactccctcccctgcaaagcacaacaaatgcctcctcaaatttttctctgccggccttcctggtcagttcctctgccgttcccactgcaaaaagtctccccccggccataattccgatcctgtcggaaaggctctccgcctcctccagataatgtgtagttagcaccacggtcactttccccttcaattcccggatcatatcccacagctcccttctcgccaatacgtccagtcccagtgtaggctcatccagaaaaaggatctcaggttctgagataagtgccatggcaatggacaggcgcctctgccatcctccggaaagcgttctggccttttttcctgcaatttcaccaagactgcatcttgcgatcatgtcctttgccttccgggcagcttcctcttttttgatcccataaataccacagataaactccaggttttctgataccgtcagatttggcgcgactgctgtttcctgaggcgaaagattgattttttctttcaccttcatgggggctgtcaccacgctgtcacccagaagctttgcgtctccggctgtgggagtagtcaggcaggacagcatttttatggttgtggtttttcctgctccgtttacgccaagcagcgcaaacagttctccctgttccacagaaaggcacagctcattcacagcagtcacatccttatatttctttgtcagattgtttgtctcgatcgccttcatcaaatctgccccctttctccagaatttctttggcaagctccataaagatttccgtctttaccatagccagcccctgctcctcatctccaagcatcaaaaggctgtcacccggtttgattccgaaaatatctcttgcttttttagggataacgatctgtcctctctctcccaccgtcacggaaccaaatacatgttttccttttggcggaatctgcagcccctctttttttgcctggtaatttaccagattatctatgcttaccccatacaatccagcaagcgccatggtattttcaagatctggcacagtctcaccgctctcccattttgccactgcctgacgggagacaccgatcttctcagctacctcctcctgggagtagcccctctgcttacgcagtgtattcaaattcacagaaatcatatttttcacactcctttccataaagtataacgcctgaatacggatacttctaccaatctgtgttaacaggatctgttattttcagttgcgcaaataattcaggaaacctcagaatttctttttctttctcattgtcttgacttttccattcttattctatatccttttctttaacaacacattaacacattatcatcacaaatgccaaaggaggctctatgcattctattatatcctcaattctgtcttcactgatactggtctccgtctgtattaatatgctccctgagaaaatacatctattctataaagtaataccttttcaagaaaactatatataaaattactttaaaccgaaaactattgtttttatattctctttcgtatccgtctgtgctgtcatctttattttcaattttacctcaggcgaacatttagaatattccccagtgttttagtcatcaatagtcttctttttcttgcttattttatattaactggagtcctattatattttattataaaaacagtaaaattctcggtcaatatccttatgttttacacagtaccatttgtcgtgatgattatttcctgcaacagctaaaattaccggagatatgttcctctaaaataaaaaaaataaatatttctgctgtataagtaaaaaaatcacccttttattctcggtaatgtaacgaaaaccgcagtatttaccacatatacccataggagatttataatgtattatctggaattggcacttggcgctctcacttttacattcgcctgcactaatatgttacctgataaaatgtccattcgatataaaatacttcttattttagaaacttatattatttgttttttgactgctgattcaattggaaattacggaacttttttctgtttgatcattattcttataaatattgcattaatacaaaaatcaaaacctttaagctgtacactagctcttctgggttatataataagtgttactctcaattatatttgtctttcactgggatacctcttatttcatataaatataatggacttaaatcctttttatggcacaatatttgattttttattccttattctctcttacctcgtgacatatacattgggattttatttaagaaaacttatatataaatttactttcacccgtaaactgctatttttgatctttaccttcgtagtttcctgtgccattatatttattttcaattttacctccggtgaatatttaggataccctccaaatgttttggtaattaacagtattctatttattgcatattttctactaaccggtgtcctgttgtattttattgtaaaaacagtaaataaggaatctgaagagaagcgtaaagcagcagaatacgaaaatttaaaggattatacccaaaatattgaaaatctttaccagcagatgcgttccttccgacatgattatttgaatatattaactaccatggactgctattttcaacaaaatgatcataaaggattggatacatattttcatacaaaaattttacccaccagagatcagcttaccaattctgatatatccctggttgcccttggaaatctccatgtccttgaattaaagagtatcatttatcaaaagctcatgctatcctcttcgcaatgtttacacctggaaattgctatacctgatgttatagatcatattccctatatggattccatggatttgtccagagtgatcggaatatttttggataatgcaatagaagctgcggcagaaactgatacaaaatttttattttgcggaattataaaggacaatgattttcttacgatattaattaagaattcttgtaaatctcaaattattaatattgaaaatctatatcaatccggtcatacgaccaaaggagacggacatggtataggacttttcaatgcacgaaaaatcctaagccaatatcctgatattttacacaataccaattgcaataataactatttcctgcagcaactcaaattaccggagacttttacttctaagggaaaaagggtaaacatctctgctgtataaacaaaataaaggaggtttctatgctttccatattcatttgtgaagatgaaccacagcttctccgtctgtacgaagaagcggttcaaaactatttgttatttcatgattactcaatggaaatcacctgtgtatccgaaaatgctgatgacttactggccgcggtccgcaagggacgcaacaaaggtatctactatttagatatcgatctgggtacaggaagagaggggattgaactcggaaaatcgatccgtgaactggaccctgatggatatattatctttatcagttctcattccgaactaagtctgactatactggaatatcaaataacagccactgattttatcgccaaagacagtccggcccaaatcaaggcccgcatcgcccgttctcttgatacgatacatgaaagagaatttcatccttcccagtctgcagacactttaaaaataaaagaaggccggcagataatccagttgtatcaggaagatatatactatattaccaaagtgccaggtacccataaaatcctgatttatacgaaaaacggcacccatgagatccacggaagtataaaagaattagaaccaaaccttgccccttacatgctgcactgtcacagctctattatagtaaataaaaaccatatccgaagcattgacagcaaaagacactgcattcaactaaatgctggatacacctgtgatatctctgtccgatatctaaaaaaatacagcaaagtatatgatctgtaacagttcagccttccactgtcccgcgaggtgttgccttgcatttgcaaggaatcccgaggcagccatgcgccggactgcggttttgacagtctgcgtgcatgcttttgttgctatgaagcctaaaggctgaatagtaactatgatcttatatttatgtaccgcccacaaaaaaagcatggagagaccttctcagcagtctctccacgccttttttcacaaaatttcatatctatctatatatctccggatgctctcccagaatcctttctgccagctccctgctctcagtacagacctcttccatgatcctgtccacatccggaaatctccacaagcccatataagacttaaagatcacatccggtatgcttccctccatcatctccaggctttcatcatagagcacgagggtgcgttccatactgacagaaataaagttgccgtaccagcccattttctcggcttcctcatccgacagatccggcctgtagttgtcgcggatactcatataagtctccaccccggactgtgcgatcacatcgagcagtatatcattgcgcagtatatcccggtaaaaggcctcatatttttctgaggaaaacaccatgtaattcagattgacaagaagcccggaatacaggatcggattcctgtgccggttcacatacatcttcgcaaaagcggcaaatctatgatacatccgctgtacgatctccagcgcaatatcacgttttgtcttaaaatgataagctaccagccccaggctcacatcagcggcagccgcaatctgccgcatacttgtcttctcatacccttgttctataaaaaatcctcgcgatactttcagaatctcttcctttttattttcctgttttttcccttctccagcagatgttcccataaatacttcctcaacttttctttaatattccggcactcccataatatcagtcttatttttagaagtcaacaataattgtccactttctgctgtggccgggctgacccgggattttacttcgcacggcgaagctgacgggcattctgtttttcacagaaacaggaaaatctctctgctgaaacagagagattcccccttgatcgtatataaaaatcaaaaccttatttttcctatctgcagctgcagtcaatggcatcattcggacagttcatggcacatcggccgcactccagacatccgaaatgtttgatctcatatttcccgtcagctgttggatggatcacatcctccatacagacctcctcacaggtgccgcatcccacacagcgctcctgatcgatcacataggcccagggacggactttggcaccgccgaagcagaaacgcagacggcagacaatgtcatcctcgggaagatggaaaatctcaccctccccgctgtccaggataaagatacggaacatatccagatctttcctgtaaagtgccttggttcccggattcaattcccagtatttcgcatagatctcagggtgttcttccgggtctatctctgtcacatgggcattcagtctaacacttgcagacagacgtttcacggtatctcggataatggttcccaccagatatggatttttctgaagctcataatatacgggctttccctttgcaattcctatataaaagtttccttcatcgtccagatagtgcacttccagtcctctggctgtgggcatcttcccgtcaatcgcggttgtgccgaacaccatatatcccacttcatggacaaactgaaatgctgctttttttatttcttcattggagctttcctccgtcagccccagagccggagccggattaaaatctgacattacaatacctcccaatctgaattttatctctggtatcccctatgcttcctcgtagctgacttctatctccaccttgtggaacttctgacggatcagcggataaatacatgccacagccagataagtcaaaattccgataacataattcatatggatctccagacactcatagtaaacaaatgccgcactgacaagggcacccatgacacataaaaatgtatacagtttatcattgatatggaactgggagcgtttccagatttccggtattttcttaggcatggtgataatagccaggcacagaatgacctgtacacagttagccagggtgtttccgatatttgcaatatctcccacattcatgccgcttaaaataataactgagcagagtacataaattgtcaggatgatataatggggtgtaccgaacttgtcattacgtttcgcaaaaaacttcggccaccatccatcttccgcggcctgtgcgatgggggcttgcagccatcccaggtttgcgttcagagatgtcaccaaagctaccattgcgccgcccacgataaagaaaatatacaacggagtgggcaggatttctcttgccaccttggacaggttctggcctgcaacatgttccaccgggaacacacctgctgcaaccacacctacaccgatgtaaaggatcgtaacgatcacagttccgacaacgatacaaaacggaatatccttcttggggttcttggcctcacggctcatattgattataaaggtagcgccgctggtggccatggacagcaatgctgccgcagacataactcccgtgaatccgttcgtgaaaaattgattctcatcaaaatatcctggttccagatggatgattccgaaacctgtaaagagaagcagcgcaattaccagaacaattaccagcagatattgtactttcgcagccacctggattccgcagagatttaagaccacgaatatggtcaggatagcgaaggccacgatcttgccgttgatctccggaaacgcggagagcacgtagtccgcaaaggatgcagaatacatggtcgcgccaaaaaagtaactgacaaacactacagaatacagtccggcgaaccacttgccgccgaacatggctgcctgcgtatagaatccgccgttcatacggatcgtacctgataaaaagaactgcggcagtgccacaatagttaccataaccgcacagataatataggacagtaaaatagaacgccctgtgataccaatggcaagaccggtcattgtcataacaccgccgccaattacgttaccgattgcaatcgccagcaaatcgccgcgacctaaactttttgaaccatcagcatttgttttagccataaatattcacctctcacactcagcccaaacctcaagttttccctttttccttcaaacggcagatcaatgccgtatccgcctgcggacattttgtataacagatgccgcagtcgtcgcaatccatttcttttatgtaatatttcccgtcttccttctgatggatcgcgcgttccacacaattttcctgacagacaccgcagcccacacactcctcggtgatcctataagtcatgggtcttatctcatctccgccgaatgcaaagcgcagacgccgtattctctcattggcgtacagatggaaaatctctccttcccctctgtcaagcttgtaaagagccactatgtcaaaattcttccggtacatctcttttgtaccgggattcagtttgaaaaactcatcccaaactgcctggtcttctgtctcgctgacccatgcactcaaacgcagagaatatctctcatctatcagcgtattcagcactaactgaggacgtttgcagagttgttcatatgtgggtttccccttggatgtcatgaaatacagattcccgtcactcaggcggttaaaatccagtatcctgttctccggctggccgtcgttcacagttgccgccggcataaaacgtatcttaccaatcagtgcaaatgccttctcccggatttcctccatggtattgacatctgtaagaccccataaaatatctttttcttccatacgcgtaacccctttatctacttgctctctcctacctcaatgaactttccgccgatattctttacaatcttgccggcctgttctctcacatattcactggtgagcagaatcgtcataaagcagtggggacgaatgatttttttgtaaacgatcggacagtgttttactcctgcgggacagtagatacatgtattttttgtgatggtgtaaggctctccgtcaatatagaaatccgcttctccccacacagcattaatgtcatctcccactccgttgtaattgggcatgaaaaataccagctcatccacgtcatgtacatgttcatccacataaggattcttattgggaatctcatagaaccaggacaggctcatatttaccttgcagtcaggaaacagatctgaggagctgtatgtctgccccaatgttcttcctgtcttgatatctcctttgtcgtccctttcatcgtccattaccggcggtacataatccggagaaataataagatgttcccattttctattacccattttcttacctcccataagcagcccctgtttggtgtgcacttccaaaaagagctgaatttcaaatgccttttccaactgaacgcgttcagtttgttcttgcctctattatactgaacatgttcagtggtgtcaagtaaaacactgtctttttatctcattaaagtgcggtccgttactgtctgactgtaaaaagtaacagatttcctggtattgtaatgatatgaaaaaagaaaagccggaacttttaaaaagttccgactgcatcctcttatacttttatttcgtttgatacttgtgtttcgttttgatacttctgtttcttttttacacttcagcttttttacacttctgtttcttttttatatttctgttttttacgcttctgtttcttttttatatttctgttttttacacttatgtttcttttttatatttctgcttttttacacttctgtttcttcttttttgtctgctattctttcaaagaccatctcatatccgtcattgccgtagttcagacttctgtttacacggctaatcgtggctgtggaagcccctgtcttctcagagatatccaaatatgttctcttatccttcagcatcttagcaacctcaaaacgctgtgaaagggaaagaatctcatttattgtacacacatcctcgaaaaagagataacactcttctctgttctttaaactgaggacagcatcaaacagggagtctactgcctccgtatgaattttcttgctcatatacatacattctccttattgtttagttttcaccccaagtgtagtaacacatcacccgtatatatagtagcacactaaaattttaaagtaaagcagtcttgtgcactttttttatactaaagtattaaaattttattaattattgtttttatgcacatatttcttcaattcttcaacagaacggttcacgatcagttcctccggaaactgcatttcctctactatcttttctgaatagcagcggcagccgatcagttcgtccacatgcgcatcgctgttcatgactatagggacctgatattccatacaataccggagcattgttttcacattttcctccccgttctccctgctgcagcgtgggtccagagagttgttgttcagctccaacagtacatggtgctcctttgcagcctgcacaagcgccagaaaatctaccgggtagcgaccgtcatccgggtgcccgattatatccacataggaatttttcattgctcccagatatgcctgggtattctcttccctggatccaggctttatcgtagggatatgcatgctggctatgacgatatccatccgttttaaaaggcgttcttccatatccagggttccgctgtgatccataatattggcttcaacgccaaagagcatctccaccccaaacatccggcggttcagcatttttgtattatcaaaataaaatccattgcaggtacccggcatagcaactccatgctctgtaattcccagcagttccaatcccttttcagaagcagccattgccatctcacgaatcgtattgtatgcatgcccgctggcaagggtatgggtatgcacatccagaacgtatttcatttttttcacctcatatttgacaatagaaaacttaagatcctgtcttttcatcacactccaaaatggagcgtgcagattgtgggaatgaattttcggacacaatccggtactgcaccggcattaatataatgcggtactgggacagtatatcacactttgccgcgggaaagcaacaccagtgttcttcccacacacaggattctttgacggactggaagatgcggaagggtttttaagcaaaaacaaactgctgtcacgggcttatgagaatccctgtgacagcagtcatcgctgtatctcgccaagccggtattccctattcgactggctctttatttgatcagtttatcatttatgaaatagtcaaacagcttccctgtttactagtacatcgtaaattaaatacttcactatcactgagaataatttttcgagagtgccggcgcaaaaacgtaggcgtagcgggctacgctgaggcttttgcacctgtgctatcggaaaatcgggccagtaaatagggtagttatttaatgaacgatgtactagtcttaattcctgatatactagatgatctcgctgaaaagatctttaactgtgggataaatctttgcgaacttgcggtatttctcctcatattttgcagccagttccggttccggctccactgtgtcgatcaccttcacgattttggaagcagcatcctctacggaagcaaattccccatttgccacagcagccagcatagcgccgcccagggccgggccttcctcggattcaatgacatccaccttgatatttaatatattggcgatcatttttttccacagagggctctttgctccgccgccgcagatttttgtacgctcaatcttgacgcccagagatttggcaacctcaaaggaatcacggatagcaaaggcaacaccttccagtacggcctgtgtcatatcagctcttgtactgtccatggtcaggccgataaaggtacctctggcattgggattgttgtgaggagagcgctctcccatcagatacggcaggaaatacacattgttctcgcccagcttctcgatcttggcctgttctcctgcgtaatccttggttccgatgatctcatccatccaccatttgttgcaggacgcagcactgagcatacagcccatcagatgatagcatccgtcagcatgagcaaaggcgtgaagggcattgttggggtccacaccaaaatctttactggagataaagatggttccactggttcccagagaaatattacacattccgtcacctacggttcccgtacctacagccgcagcagcgttgtcacctgcacctgccacgatcttacaggaggccggaattcccagctcctctgcaagctccggtttcagcgtgcccacagtctcatagctttcaaagagtttcggcatctgctcttctgtgataccgcagatatccagcatctccttagaccagcagcggttctttacatcaagaagcagcataccggatgcgtctgacatatcacagcagtgtgtacctgacagtttgtatgccagataatctttcggaagcatgatttttttgatcttcttaaagttttccggttcgttttcctttacccacaggatcttgggtgcggtaaagccggcaaatgcaatgttggctgtatactgggacagcttgtcttttcctattacctggttcagatagtctgtctccttgcctgttcttccgtcattccacagaatagccggacggatcacgttgtcctgctcatctaaaataacaagtccatgcatctgtccgccgaagctgatacctgccacctggctcttatcacagtctgcagtcagttccctgatgccctccagactttctctccaccagtcttccggcttctgctcagaccagccgggatgagggaaggaaagagggtattccctggaaacgatcttctctattttgccttcgccgttcatgagaagcagctttacggcagaagttcctaaatccacgccaatatataacatgattgattctcctttatctcttaaactaaatacagtattcttctgaaatgcatgttcagatagaggctgctcttgcgggcagcctcctgattttgtcagcagatatttttatgcaaatggattctctgttggatacagaacaccttttggctggttgtagttgatttcttccacttccacgcctaaatatttgaatacttcatataatgcttttccaaagtgaccgaaagccacagctccgtgatgcggatagttcttctccaccagaacgtgacggtagaaacgtcccatctccggaatggcgaacacaccaatggcaccaaaggaacgtgttgctacaggcagaacctcgccctgtgcaatgtaagcgcgcagtttgcagtctgctgtgctctgcagacggtagaatgtgatctcaccaggagcgatatcaccttccaaagtaccctgtgtcacttcttccggaagtgttcttgccatgatcatctgatatttcatggagcagaaggacagttttccggatgcggtattgccgcagtggaagcccatgaaggtatctttgtgtgtatagtcgtatttgcctttgatctcgccttcatacatgtcagccggtactgtgttgttgatatccagaagtgtaacggcatcctggctgataacagttcccagatattcgcttaaagttccccagatatccacttcacaggatacagggattccgcgtcctgtcagacggctgttcacatagcagggaacaaatccgaactgagtctggaatgcaggccagcattttgtagtcagagtcacatattttctacatcccttgtgagcttctacccagtcaagcagtgtaatttcgtactgagccagtttcggaaggatctccggtttcatattgccttcgcccagttcgctctccatatcttttacaacatccgggatacgcgggtcgtcagcatggtttttatagctctcaaacaggtctaattcggaattttcctcgatctcaacgcccaggtcatagagacgtttgattggtgcgttgcatgccaggaagttctgaggacgcggtccgaagctgataatcttcaggttcttcactgctaccagcgcacgggcaatcggtgcaaagtctgcgatcatttctgccacttcttccggtgttcctaccggatattccggaatatatgcttttaagttacgcagtttcaggttatagcttgcattcagcattccgcagtatgcgtcaccacggccctgaaccagattgtctcctctttcctctgcggcagctactaccatagatggtccgtggaaatattttaccagaagggtctcctctgtctcaggtccaaagttaccaagataaacaaccagtgcgttacagcctgcttcacgcagctcttttaaagctttctgcatgtcagtctcgctctctacaacggtgggacattcgtaaatctctcctttgtaggatgcaacaactgcttttcttctgttctctgacagtgacattgggaaacagtcacggcttacagccacgatacccagttttaattccggcatgtttgctaaattcataattcttatcctcctgaattttatgttgctgttttctttttatttgttttctggtttccggttatcagtcttttacagacaggttctcaccgatcaatccctcgaacgcgccttcgatcttggcgtctttgtgggcgatcagccatttgtttctggcaaagagaagtttgtcctcaccggtgttgttctgaacagcaggtgcctctgtgttggtccctttgggaagaataactgctgtgcagaatttatttccgtttacattacatggagcatagtgcagggtagtggcatagacttcgatcacggttcctgccggtactaaaaatgcttccattttagatgtgtcatatgtattgtctgcttcgatgtcctgctctcttccgagaatcaggatcaaatctgtcaatgccacgttcacctcactgtctctgtggtattccacagcattcagcaggtagttgcttccgttgcagtagccaatctggacgggcattccgccgaacaggctgtaagcgatcttctctgcacagtcacaggcttccagcttctcatccgatgcgacatagatgacatcatccggcttcggagtttcctccagcgctttcagaagactgctcacatcaagaccttccacgaccttaccataagccttgaattcggcatccctgacatttaaaattttcatgggaattgacctccttgggaattagtttatccattaaactatatactcatgctaccattgacaggaagaaaaatcaagttgttttttcaaaaattaataagtttttttgaaatagggagtcaggatgaacagatccggagagaaacaacaaaaaaacaagacggaatccatagcatcctgcattccgtcttgttttcctttcccaaagagagtggaaatttattttcacttattttaatacgatatccttttcaaaatacgtcttagaaatttctgtcagcgtcccgtcctttatcaaaggcttcaaagcctggttctcgatagccggaatcagacagcttccctttttgccaaatacagcaagctctgtatattccacctcttctcccagtttatcccgtacctttgagacatctgcgtatgctttggtggcagagtaatatttttgattccaatcggttatgcctaccgtggagataacacagtcatacagatcagcatccagggaattcaacagattctcttctgttgtgtctatgatttccagggacagtcccaatttttccgctatttttgtagctgtatcaggggcaaaacctgctggtttggctgttttttcatccacgtagcccatggagccatcctttaaattgatgcccactttcaggacacctttttctatggttgtgatctccccatccccttcacagtctttcggggttccgcatccggccaatgctgcggctgtcagaactgctgctgccagagcacagactatacggcggattttatttttcttcaattgtaaccacctcattctttgttttccgatttgcaaatacctatgaaaaaacataacatgctctgctctttttgtcaaatagctgtgaaaatattaagaaagacaaaaagaggatcgtcttgacaggaacaaaatacgaacatttgtttttttacttgtaaaagatttttccttttggtatgataatagaaagcaaacaacggaaaggtttctggatatgaatgcatggaatggaaaaccctatcactcttttgactatatgctgaaagagcggttttcggaaaaagtttataaagtggcattgaatggggggatgacctgccccaaccgggacggcacccttgacagccgcggctgtatcttctgcagcgcgggaggttccggagattttgcgggtgacaggaggctgtctgtcacacagcagatcaatgagcaggctgacagaatacgcagcaaacgaaatgcctctcactttatcgcttactttcaggcctataccaatacctacgcacctgtggaatatctccgggagatttttacggaggctgtttcaaatcccgatattgtggcgttgtccatcgggacccggcctgactgtctgggagatgatgttctggaacttctgagcgaattaaatgagcagaagcctgtatgggtggagcttggactgcagaccatgcatgacagcactgccgcatacatcagaaggggatatcccctctctgtttttgaggacgcggtacgcaggctgagagcattggatcttgaggttatcgtgcataccattctgggacttcccggtgaaacaaaggaagatattctggagactgtctcctatttaaatacacaggatatccaggggatcaagctgcagcttcttcacatcctgaaaggcacagaccttgcaaaggattatgaggagggcagattctctgtatatacaatggaggaatatatcgatcttgtcatagcctgcctggagcacctttctccccgcattgtgatacacagactcaccggggacgggccgaaggagcttctcttagcaccgctctggagcagtgccaagaaaacagtcctcaacacactgcaccatgagtgcaaagtcagagggagttatcagggacggctttacactgattccaatgtacaccagatggcataaaaaaggaggattctttatggctgaaccactcactttatacaaactgatcatactatacatgctgcagaaggtggattttccactgagcaatgcacagatatcaggatttatactggacaaaggatatacaaactactttcatctccagcaggcgatctctgaactgatcgaatccggtcttgtacgttcagagactgtgcgcaatgcctcatatctgaagatcacagattcggggaatcagacattggaatacttcggagaagaagtctccgatgagatcaaaaaagacatcgaaaaattcttccttgaaaattccatggaactgaaggaagaacgctccgctatggctgactactacaaaagcgataaggaaggatatctggtgcgctgccaggcgaaggaaagagatattcccctcatagatatgacactcaccgtacccacaaaggaagccgctgaggctctgtgcgcggcgtggaaaaacaaaagcaaacaggtatatgaaagcctgctggatatgctcctatgagtattccgtaacttatggcatattgctgtgccataagttaccggatgccccggtcatatccggcaggctttcattggcccttcattgacccttccgtatcctgtccagatgatccttaatgttcttttcgtaaccgttttctgtaggctcataaaacctgctgcccagtatctctgttggcaggtactgctgttccacatagtgattcggatagtcatgggcgtatttatatcccacgccgtgtcccagttttgcagcccctttataatgggaatcctggaggtggggcggcactgtggtacggacgttttttacggaatccgcggcctggaataccgccatgcaggcggcattgctcttcggtgcgctggccacataggtcacagcctgggaaagggtgatctgtgcctccggcatgcccagtcgctccactgcctgcgctgccgccactgccacaactaatgcctgaggatctgcattacccacatcctctgaggcgcatatcatgatccttctggctatgaatttgatatcttcccctgcatacagcattttggccaggtaatagaccgctgcatccgggtcagaaccccgcatactctttataaacgcagataccgtatcgtaatgattgtccccggttttgtcataacgcactacccgcttctgaatacactctgaggccacgtcaagagtcacatgtatctttccgtctgcccctttttccgtggtcagtaccgccagttccagggcatttaatgctgctctggcatctccgcctgcgatatctgccagaaactctctggcatcctcctccagctccacatcatagctccccatacccttctccacatcagtggcagcccggatcaggagtctgctgatatcccggcgctccagcggcttcagctcaaaaacaatggagcgggagatcagggcgctgttgacttcaaaataaggattctccgtggtggctcctataaggatcagggttccgtcctccacaaaaggcaaaaggtaatcctgctgccccttattgaaccgatggatctcatcaataaaaaggatcgtctttttcccgtacatgcccagatagtcctgagcctttttcaccacttcctccatatccttttttccggcaactgttgcgttcatctgttggaactgagcgctggtggtattggcaatgacctttgccagtgtggtctttcccgtgcccggaggcccgtagaaaagtacactgcccagcttgtctgcttttatggcacggtaaagcagctttcctttaccgatgatatgctcctgccccaccacctcttccagcgttgtgggacgcatcctggaagccaggggagattcattttccagagtctgttctttcatataatcaaatagatccattattttctccttattccagcaacagttcatccactgtcacaaattggtatccctcctcagtaagtgtatctgcgatctgcagggcagcttccacggaggtgtcaaaaatatcatgcattaaaataatatcaccttcctccacatctttcactaccctttttacaattttttctgtattttgcgttttccagtccagagaatccacattccaggacacggggatcatggtgatgcagaaatccaggttctttttccatgcaccgtatgggggacgcacaaaagaagaatatgttcctgttgtttcatatatcttgttgcaccctttcagcacttcgtctcttgccttagactctgataatttgttgagctgtacatgattgtaagtgtggctgccgatcaggtgtccctcatcctggattctctttacaatatcctcatttccctctatgttcttgcctatcagaaaaaaggtggcgtgaataccgcgttttttcaggccgtccagaagttttggcgtatagaccgcgtgagggccgtcgtcaaaggtcagggcaatcttgggatgttcctcatctgacagttctcctgcagtctgtatatccatctttccaacggactctgtaccgtatttcagcgcccccactgctgtcagtaccagtaggactgccaggcagagccatgttttatttttactcatatcgcaactccggccaaactgttccttctatttatatgtctttatttttgtgaaaagactttctcttcacacgtcaatatgataaaatatcaaaataatgtttttactatatatataacaaaccatacaacaaaaggccgaaaatagttactgttcgcagatttgcgcatttgcagggctgcgaatcgtaacgggaaatgctttaagatgctgccggccgagggagggagttttcacatgacattagacatattatcttcactggccatctatgccctggtgacgggatggtcgcccggtcccaacaatgtactgcttctgagcaccacagggcagttcggactgaaacgaagcatgaaactgatcaccggtatatggaccggttttttgactattatgcttctgtgtgcaggcttcagtgtagggttgggcagatttctgcccggagtggttccctatctgaaatacataggcgccgcttatatcctgtatctggcatttacagttctcaaaagaaagcctgtccaggccgatgatggcacaggcaaagcgccgtccttcgcctcaggatttctcctgcagtttatcaacgtaaaggttatcctgtatggcatctccgctctgagcagctatgttcttccctacgaaagcggtattccgtctctgatcttctttgcctttttcctgacctttttcggtgcaacgggaaatctggtctgggctatcatcggaagcatatttcagaaatggtacaatagatattatagagtgttcaatatcgtaatagcgctgctgcttctgcgctgttctgtaaaactgattctgtaaggctgtttctgcaaagctttttttgcaaagctgtctctgtcaaattgattttgtattcaacagtatctctacatatgttcataaaaaactgccgtcggtgcggttccatttcacggaacctatcaccagcggcagtttttcttttattatttcgtattcgttacaaatgcgttgactaattcctgtccgtcgtcatatccctgtgatttcagttctttgacaaaccagtcctcaatcccgtcaactgcttttttgaaggaatcaatgtccagatcttcatactctgtaatcttcacgccgttcttttctgcccagcgtttcttgatctcattatctccggcccggttgatctcacgctcatattttactgcttttgctccggcttcatccactaccttctgctgttttggtgtcagactgtcatacagcttctgattgatacagaagaacaggcagtcatagttggcattccacatagagcagtatttctgcacttcctgtacactggctgcatctatagccggaaggggattttcctgtccctccacagtattctgctgcagagccgtataagtctctgaccagttcatattggtggcgtcagccccccatctcttatagcattccatgagcagattagagcctgccacacggatcttcaggcctttcatgtcctctgcggatttgatatcccggacagaattggtcagctcccggaagccgttctcagccatacccatacagtgcaggccgtattctccaaggatttccttcatcttctctccgccttctccatccagttttttgtccgcgtcttcaactgactggaacaaaaacggaatggaaaccacattgaaacgagggtcaaaggccgaatagatcaaattggaatgcatggatatctgtaccgggtcaccatccatcaaagcctgaatgccctccgactggtttccattggtgagctgatcggctgcatagacgtttaccttcactttgccgcctgtggcctgttccatcagttccccgaatttttctccggcttttgcccaggtgcttgtctctgtggtggagcaggcaaaattccaggtctgctcactccagtccagatcactggaatcttccatcgtatactctgcggtgcttccctcctcagaagtaaatgcggcgatcagttcgctgacctctgacttatcataaccttctgttacaagttcctgttcataccactggggaatgtcttccacagcttttttgaaggaatcaatatccagatcctcataggcagtcacatccataccgttttctgtctgccagcggttcaggatctcatcatccccggcgcggttgatctccctctcatactgtacggccttctgcccgatctcatccacaacctcctgctgcttgggcgtcagcttgtcatagacttcctgattgatgccaaagaagagacagtcataattggcgttccagagagaacagtatttctgtacttcctgtacactggccgcatctattgccggaaggggattttcctgcccttccacagtgttctgctgcagggctgtgtaagtctctgaccagttcatgttcgtcgcgtcagcgccccacctcttataacattccatcagcaggttggagcctgccacacggatcttcagatttttcatatcatctgcacttttaacttcccttacggagttggtgagctggcggaaaccattctctgccatacccatacagtgcacaccatagctctccaggatctctttcatcttctctccggctgccccgtccagtttggcatccgcatcctccacggaattgaagaggaacggcagggataccacattgaaacgcgggtcaaaggcagaatagatcaggttggagtgcatggatatctgtaccgggtccccgttcatcagagcctgtattccctctgactggttaccgttagtgagctggtcggctgcatagacgtttacatggatctttccgcctgtggccttttccatcatttcaccgaatttacgtcccgcctcagcccaggtacttgtctctgtggtagagcaggcaaaattccaggtctgttcttcccaggcaagatcacttctgtcctccacctcataattgcctgaggttttggaggtaaacgcgtctatcagttcttttacctcagtctcatcatacccttccttcaccagctcctcctgataccactggggtatgtccgcaacggcatttttgaaggaatcaatatccagatcctggtattctgttatctccacgccgttctggtcagtccagcgctctttgatctcgtcatcaccggagcggttgatgtcacgctcatagtccacagcctttttgcctgcctcatctaccaccttctgctgttccggtgtcaaatccttgtacagctccccgttgatacagaagaacaggcagtcatagttggcattccacatggaacagtatttctgcacttcctgtacgctggccgcatcaatggccggaagcggattctcctggccctccactgtattctgctgcagagccgtgtaggtctcagaccagttcatattggtggcatcagccccccatctcttatagcactccatgagcagattggagcctgccacacggatcttcagatttttcatatcatccgcgcttttcacttcccttacggagttggtgagctggcggaaaccattctcagccatgcccatgcagtgcagtccgtattcctccagaagcgcgttcatcttatcgcccgcctcgccgtctaacttggcatctgcatcctctacagagtcgaagataaacggcagggaaaccacattaaaacgagggtcaaaggccgaatagatcaaattggaatgcagggatatctgcacaggatccccattcatcaaggcctggataccctctgactgatttccgttggtaagctggtcagccgcgtataccttcacatgtaccttgccgcctgtggcctcttccatcagtctgccgaactgttccccggctttcgcccaggtgcttgtctctgtagtagagcaggcaaagttccaggtctgctcctcccagtccagatcactgtagtcgccgatcacattgtagtcctcagagctgctgtcccctgctgtgctgtctgtactgcccgcaagtttggaagtacccgtataggagcttcctgcaaaagccttcggcagacacacggaaatctggggaatgtatgtgaccatcaacagcacgatgatacaggcggcgatcatggggacaaccgccttggaaatctgctgcagactcacctccagtcccttcttgatcttgatgctgatggcgacaaacagattgacacccacaggaggcgtcacctgcccgattgccaggttgaccgttgccagaataccaaaggctaccagatcatatcccagagccttgcacaccggcagcataatggggataaatatgtacatagcagagtttgcgtcaatgaagcaccctgcgatcaggaaaatcacattcacgatcagaaggaaaatgaactgattgtgggccacacttcccaacagttccgacgctgcctgtgaaataccgaacttggtacagacaaaggaaaacagggacgcacacgccacgatcagcatgatgcctccggttgtcttagctgattccacgaagatatcgatcaaatccttgaattttacttctctgtagatcaccattcccacaaagagaccgtataccacagaaacggccgccgcctctgtaggtgtaaacactccgccgtagataccgcccagaatgatcaccggcatcaaaaatccccaaaacgcatcgccaaaggcgcggaatctctcaccccaggacgccttcttggtggtgggctggatcccatttttgcggacttcgatcatgatgacaaaaatcagggcaagtcccatcagaattcccggcaggataccgcccgcgaacatatccgcgatggacacaccggtaatggacgcgtataccacaaatgcaatactgggcggtatgacaatagctatggagctggatgtggccatcatagccgtggaaaacggtgccgagaagcccccctcctccaccatggccggaatcaggactgcacccagagctgcaaccgtagccgggcctgaaccggagatcgctccgaagaaacaagctacaataacgcacacaatggcgataccgcctcttttgtgccctacgcaggtatttacaaacttgataagacgtttggatatgccggcctttgccataatatttccggataagacgaaaaacggaatggcgagaagcaaaaacttactgatgccggaatacatattggttgccacaatggtcagggacgtgcctgagtacaggatcgcgcacacagaggacaggcccagacagatggcaacaggaacattcaggatcaaaaagataaaaaaggataaaaataataccgcgcttaccatttatgcctcctcctttttctcaacaaatttaaaatctgtacaaaaatcaatacaatactccacaaaatgcaggatcatgcagaccgctccaataggcacaaaggaccagaagatccattccggccagttcagcacaaaggtcctctttccgtttgcaagctgggtcagcaccttatccatgccgtatttaaacaatattgcagtgaatatcacagagagcacagtcacaagaatgacaatgggtttcttagttttctttggcagcctgtctgtgaccagcgtaaggcttaccagctctccttcccggcaggccagagcggctgccataagtgtgatcaatacaaaaactgccaccaccagttcttccgtaaatgaccaggaacggtggatcactttcctggaaaacacatttcccacagtcagaaccaagatcagcagtgtagacgcagccaggatcagcttctcagccgaagccagcacatccatgatttttttgtagactttcatcacatttcctcctcttgttataataagacttataaaatcccacacacatctgcccgtgtaccgcgcacattcagagcataaaaaaagcccctcctgaagagggacgaacaaaatccgcgataccaccctgtttccgcacagagttacccctgccggcacttacaacatactgacatatgtgtttcctgtaacgtggaacctacgtcagcacctaatgggacattctgcctttcagtgctgcttctccgggatgatccgtaagcttcccggattcctgcctcacacctgccggcagttctctgaaaatccgtttggcagcttatgcttcccatcatagaatttacaaatactgatgatcaactctcaatattttataatatcttaatggatattttacttctttttcagaatcacgtcaacacttttttgtaacatagtaaaaccgctgtaacagttcagtcttccactgtcccgcgaggtgttgccttgcatttgcagggcaatcccgaggcagccacgcgccagactccggtttttacagtctgtgtgcatgccttttgttgctatgaagtcgaaaggctgaatagtaacaaaccgctgccccgggattgctcctttgggcagcggctatatgttccatatgaattaagcgattttggattttgccagctctgccagtgttgcaaagccttctgcatcattgatagccatatcagccagaacttttctgttcaggtcaatgttagccaactttaatccgtgcatgaatttactgtaagataaaccgttcattcttgcagctgcattgatacgtgcgatccataactgtctgaactggcgttttctctgttttcttcctgcgtaagaagatgtgagagctctcataacagactgttttgcaactctatactgttttgatctggcacctctgtaaccctttgccagctttaatactttattatgttttttcttagcgtttaatccgcctttaattcttgccattcttaatttcctcctgttttagaacctatcctgtaattagatgtacggtaaaattttcttgattgcttttacgttggttgcatctgtgatagctgcttttctcaggtttctttttctcttctgagatttctttgttaagatatggctcttgtaagctttgtttctctttaataatcctgtacctgtttttttgaagcgcttagcagctgctttcgttgttttcatttttggcatgtttgtattcctccttagactcttttcgtgaacgcttttagcgtttttctgtcaaatacatggtcattgtcctgccttctaccttcggtgctttttcaatcaccgcgatatcagctacagactctgcaaactcatcaaggatgtgtttactcttatacatatgtgccatctctcttccgcggaaacgtaatgtcactttgactttatttcccttggataaaaattttctggcattattgaccttggtgttcaggtcgttttcctcaatattaggggacaaacgcacttccttaatctctatggttttctgtttcctcttagcttccttttctttctgcgctaattcgtacctgtacttaccataatcgataattttgcaaacaggcggctttgcagtcggagcaatcttcacaaggtccagccctgcttccattgcctgcttctgcgcatctctggctgacatgattcccagctgttctccgtttgcgccgatcagacgtatctctttgtctctgatttgtccattgatcattaaatcgctaattgtagtgcacctccataatattgataaaacactctgttcctggccggccctccggccttccacctcataaaacatcctgaaagaaacaagaaaaaaatggatagacgacaatcgactatccacacatatccgcataaagaaaacgctgaaggcgcttcgtttattaccgtattaaccatagtcacgcgattgtgctaaggtgagagtggatactctgctttctttttcttcagactagataagtctaacacaggtgtttccatgcgtcaagagctaaatttcattttgtttttatttttattaagaaaattcttgtcttttgtctgaaaaaatggcataatgtttcacatacaacaaagatgcgaaacgcatcgaaaaaagggagagaaacatggagaaaaaaagaggagcattttctaacaagatgggatttgtccttgccgccgccggatccgcggttggtcttggaaatctctggcgcttcccgtatcttgcagcaaaatacggagggggcatttttttactcgtctatctgatcctcgccgtaacacttgggtttacactgatgatcactgagatcgccataggccgtaagacaggcctgagtgcagtgggagctttccgaaagctggacaaacgatttggcttcgttgggtatctggcctgcatcgttccttttatcatcaccccatattactgtgttatcggcggatgggtgatcaaatacctgatcacttttgtcagcggcaacgtatccgcggctgccggagatgactattttacaggttttatatcccaggccggttcaccggttctgtggtttgcagttttcgttctgctgacttccatcgtcgtgatcgcaggcgtggaaaaaggaatcgaaaaagccagcaggatcttaatgccggttctgatcgtactcacactgggcatatccattttctgtatcacaagaccgggtgccgcagaaggtgtgaagtattatctgctgcctgacttcagccgtttctcagccaccactgtgctggctgccatgggacagctgttctactctatgtcactggctatgggtattatgatcacatacggttcttatatgaagaaggacaacagcctggaaaaatctgtccgtcagatcgagatcttcgataccggaatcgcttttctggccggccttatgatcatcccgtctgtattcgtattctccggcggcaacgaggaggcactgggcaagggaccatccctgatgttcatcactctgcctaaggtgtttgacaatatgactctgggcggcgtcattggagcagtcttcttccttcttgtactgttcgcggcactgacctcctccatctcactgatggagaccaatgtgtccattatccgcgacaaactgggctggagcagaaagaaaaccacagttgcagttaccatatatgtactgcttctgggcgcactggtatccctgggcttcgggcctctggattttgtccagatcatcggactgggacttctggatttcttcgatttcctgagcaacagtgtactgatgcctgtcgtggcaatcctgacctgtatcagcatcggcttcttcatcaagcctaaggcagtatatgatgaagtggagctgaacggaccttttaaaatgaaaaagttttataccatcatgcttaaatggatcgctcctatctgcctgatcatgattcttgtattcgcagtatctgaggcaatgggctggatcaaagtctgacaaaaagagccatatctgtaatttcagttacaggtatggctcctttttcatatcttatggtttcttatcttttttcaaagcttccgcattttgtctcgtcacagcggcaggcacttccgcctgtaattgtgatcttgtctgcatgacatttttcttctttattgaaagtacaggtacatgcgcggcagtccacatcaatagtgcggcatccgcagctgtcagcagcggctttattggatgcagattctcctctttcctcaaagctgcggcagcaggtctcatccgcaacctttgcttcgcttccgtctaccagaatgtctcctttggagcagtattcatctttgttgtaaatacaggttcttgcagtacagcttaataatggcatagtcatttcctccttataatttcgtcggaaatagtatgcgtttcgccgtacggttttataccatggatttttcaaaaatttatttctgctcttcttcttttacctcacggatctctctgctttttatctcctctttgatggaggtgataaactcaccaagatccttttgtccctcatcgcccaggaaacggcttctcacagacacaaggccctcctcttcttctttggcgcctaccactatcatataaggtattttttccagtctggcctcacggatcttgtagccgatcttttcggctcttgtatccatgtccgcacggattcctgcctccaaaagctgtgccagaacctttttgccgtaatccatatatttgtcggaaattgccaggacacgcacctggaccggggataaccaggtcgggaatgcgcctgcaaaatgctcgatcaaaataccgataaaacgctcaatggagccaaatgccaccctgtggatcatgatcgggcggtgcttttccccgtcagcgccaatatattccagttcaaagcgaaggggaagctggaaatcaagctggatggtaccgcactgccaggttctgccgatggaatcctccagatggaagtcaatcttaggaccatagaaagcgccgtccccttcgttcaccacgtagtcaagctccaggtcatccaaagctccccgcagggcttctgtggccatttcccagtcctcgtcacttcccatggaatcctcaggacgggtggacaattccacatggtatttgaatccaaacaggctgtaaacctggtcgatcagcgctgcgacacctttgatctcatctttgatctgctcaggcatcataaaaatatgggcatcatcctgtgtaaaacagcggacacgcattagtccgtgaagctgtccggatttttcgtggcggtgcaccagtcccagttcccccatgcgcagcggcaggtcacgataggagcgcggttcagactggtatgccaggatgcctcccggacagttcatgggtttgatggcaaaatcctggtcgtcaataaccgttgtgtacatgttttctttatagtggtcccagtggcctgatgtctcccacagatgacggctcaacatgatcggcgtggaaatctccacatagccggcttttgtatggatctccctccagtaatccagcagggtatttttcagcaccatgccctttggaaggaagaaggggaatcccggaccctcatcgcgcatcatgaacaggcctaactctctgcccagttttctgtggtcacgtttctttgcctcctcgatccttgccagatgctcctccaggtcagccttttttgtaaacgctgtgccgtagatcctggtgagcattttatttttctcgctgcctctccagtaggcaccggcaagacttgtcagcttaaatgctttcaccggttttgttgtcatcagatgggggcctgcacacaagtcagtgaattctccctgtttatagaaactgataacagcgtcttcaggcaggtcctcgatcagctccactttataaggctcctctttctccttcatgaacgcaatggcctcctcccttggaagctcgaagcgctcaatgggaagggattccttcacgatcttcttcatctccgcctcgattttttccaggtcttccgctgtcagagggatttccctgtcaatatcataatagaagccatcggaaacggatggcccgatcgccagttttgcatccgggtacaggcgcttgatggcctgggccataatatgggatgccgtgtgacggaaagctgccttgccgccctcctcgttaaaagtcaggatactcagctcacagtcatggtccacggttgttctcagatccacgacctgcccgtctgcttcccctgcgcaggccatccttgccagaccttcgctgatatcggaagcgatatcaaggacagacactgcgtgatcgtattctttttttgacccgtcttttaatgtgataatcataattcctctgctccttttctcttgtcatatttcttttgcaatactgctgacacgcgacagaacggaaaccgcaaaaaacccgccccatgcagccatttctgactgcaagggacgggtaactgtcattactcgcggttccacccttgttgtacactgtcctccttttgaggaccggttcaccactcatttgatggtaacggaatcaccgggccgtgttagggccgctccaaggtagttttcaaatgctttctgaacaggctgcttccagcatatgccgccctctctgggaacctccgcattttactcgtcttgtcatcgcgttttctgtatgaatctacttttcattatagccgcagaaatatttttgtcaaccgcttttgtcccagaaaacccagcggatatggacagcagcatatatttcatgctattttatcagttccagaagctcctccctgctgatcctgtggtcagccactgcctgtccttccatgacattttccgcaagacgggctttcttctcctgaagggccagtatcctctcttctatggtattcttcaccaccatttttatgacggtgacgatattctcctgtccgatgcggtgggtacggtctgtggcctggttctgggctgccacgttccaccagggatcgtaatgtatgaccacatccgcctccgtcagattcagccctgttcctcctgctttcagggaaataaggaaaacctgagcctctttgttctgaaactttttcaccatttcccgtctctgctctttggtattcttcccggagagatagagataagaaatccccgccttgtcaaactccccggccaaaagctccagcatggtggtaaactgggaaaaaagcagtatcctgtgttctgcctgcaccaagtctcggaccagttccacacagctttcctgtttcgcggaacctcccctgtaattttcatagcaaagctgaggagaacagcagatctgccgcagccccatcagctccgccagatactttatgcgctggttcttgtaatcctcctcgctctggctgcttaattccatctgcagcctggcgactctggcgtcgtagatctttttctgttcctcctccatcttcacatagacggtcttctccagcttgtccggcaggtctttgagcacatcctgtttcttccggtgcaggataaaaggattcaccatatgcttcagccgttccatgacatttttgtcctcattctgtacaatgggctgttccagctcttcccggaactttttgtagctatagagatatcccggcatgataaagtcaaatatactccacaagtcactgaggcggttctctataggagttcccgtcagcgcaagacggtggacagcctgcacttgcttcaccgcttttgccgtctgggtacctgcgtttttaatatattgagcctcatctatgaccatatagggaaaggttctccctttatacagctccgcatcccgcttcaacagatcataggaagtcaccagtatatccgatccagatgcgctttttatgatcccttctctctgctgactgctgcccacagccactgcgacagaaaggtccggcgcgaaccggccaatctcgctctcccagttatagaccagagatgccgggcacacgatgagggcgccctcttttttcatttccaacagtgtgataacctgaagagtctttccaagtcccatatcatccgccaggattcccccgaatccccactgggacagcatggccagccagcggaagccgttcttctgatattccctgagttctgccttaagttcctcgggaatctcaaaatcattgtcctgatagctgttcatctcacggatgagccgtttgaattccggacttcttctggcatccaccttgcccggctgtgctttcagggtctccgctatgtaggaagcccggtacttgggagcagtaaagctgcctttggcgaaattatttttgtcaaacccaagcccctgggacagctcagatatgagagaaaggccattgtcctcaagactgatgaagtccccatttttcaggcggtaatactttctccgcctgcggtatccggataggatctgctccatctcccgcagatccatatcttccacccggatatccagatccagcagatctccggacatgcctatgccgatgttgactttcggggcggggagaatccgcattctctttatcttgtcatccacaaaaagggctgccagttcacggatcttgggaaatccctgttccagaagatcatatattttttcctcttttacacaaaccccatagatttccccgttcttctcttccatgtcaaaatatacttccagacattttttcagagcgtcttccctctgcacgtcacggtactgactggccggttctatctctgcgaacagatcatagactgtatttccatagactgcctccgcccgcatccgaatggcatcccggtattcttcatctatgcttaagtacacactgcactcggcctctttgggctgatactcatcaaaatcaatatcgttcatctgaatatccgcatactgttccaaaacaggcagcagtgtcccgcagaatgcagtatagtcctcctgattcagaaaaacggaacggtctctggactgaaatgcataatgctgtacattatccgtgttcagggctttgacaatgggcatcatatccgctgaaaagtcaggtgtgcactggtaaataataccgtctttctgaagataatcgtgaatatttccttttatccacttgggggaatgcagataaatgctggctccctgctcctctgttttaacgatttccatcttgatctccggattgccgcgtctgacctgataaggggttccgtctatctcaatggtctggtccatatatttttgcagaactttgtctatcccgtagctgttcagtgaaatgctgcggaagctggagctgtacacctgggaactgaattccagattattatactgggttttcaaataatcagacagaagatcgatccaggtgagggcttccggggtaaatgcggagcggtcatggataaaccccagatttttgccgtacgaatcatatttaccgtattccacactgtccagcattttacatatgtttttcaggacatacagtttgcgtgtacctattttaaactctatatggtaggaattgtatgaggatgtgatgaccggttccagacggatctgaccgtaatattcccccaacagataggcattattgcgcacagcatactttgctatggtatttttcagcgtatctgatgtttcgcgttttctggggcctctcacgggaaagtccacgatttcctgacgctccgggggcttttgggtgtcccgataggcgagggccagagctacacagtgcttgcacatgccaaagtaattgccatatgccggacagtcacatacatagtccgtaatatcatcatgggcgtcaaaggttactgtcacatcataccatttgctgccactgccctttacctgtgcactcacttcttttgtatcctctgaaatttcctcgatcaggaaacttttgtaggccttttcctcggcaatccgcttcccccgctgatacattgccggaaagcagttttctttgaccgtgctgatctttaacattcttccctctccgatttacaaaataattgtattttcatcctgtctctgcagttacatatttcctgctgctttgtccttcaccactccgaagaattctctcacaaggtaattcacctgtaagaatgtattgcttttggaggggattccttctatatgagagcatcccagctttttccccagggccacaccccggtacacatgaaaattattggtcactactccgatggatgcctcttttcctttgccatcttcctctgtgtcgatgatctttagagaaaatttcaggttctcactggtatttgtggagtgttcctctttcagaagccgatcaggagaaactccttttttcacaagatagcggtacattgcctccgcctctgtgatatcctcccctgttccttttcctcctgagagaaccgcgcaggcctcaggattttcctccagatactctccggcacgctccacacggagtctcagggaattgctcagttttgtgccgttcacctgcgcccccagtacgatgatataatccagatcctttgacggcttgtggaacatccctgtaaagatcagggcttccactgccacaaaaacaagtacacaaagcactgccagcaccaaaagaccgtgtttcaggaccgcagggaatgcgaaaccggacagcattccgtgtttcctgtttaaatggagaaataccgcgatcccgtaaaagaagacaccgcccgctgcccatatacacggaaacagggaggacagccccgcatagacggcaatgcctataaaataaaaagtacagaggctccccaggataatacataaagtcttcattcgtatcctttcgtaactattcagtaggtctgcgcattcactgcgctgaccgtaagaaagtgtaccacggccaagcaaaaatcccatcgccaaaggcgattctgcatggatttttgcctgtaactgcgagggtactgaacagttacatcctttctatcacaaaggggcggttttcaccgcccctcctaaaaattatttatttctgccacagcagtgtttatattttttaccgcttccgcatggacacggatcattacgtccgatcttagcaccttttacaatagtgccggatttcttctgctctttgtacagctcttttttcttctcctcagtaaaaatctcatcccactggggaagttcatacagccagtccgctttggcgtccaccatgttcttatagagaagttctttgtcaaatcccagattgacttctgtattctcgtccatctcctcaatagggttctgaactttcagactgtcattaataccatccaggaatccgaccatggtcataacttctacttcaaatttatctgccaggtctttcactgtgccgcggaccacttcgtccgggttggccagaagtttttcatagattcctttttcaatcagaaaatagttggtccagaatttctgcagctgcgctttgtctgcttcctgagaatacgcaacgtctctccattcctgtaataatgccatgtatctttaccaccttttacttattatcgtattttgaggcgtcccgaaacgcctgacagatatagtatatacgatatgacagattttttcaatccttacttttttcagacatttttacttttcctgacttggcagtatccattttccgtttgtgaaatccggaactgccaccggctgacccccaagggcaatggactcttccgagaggacactgatacacatccaagcggctgcatcgtatacatcaatggggcatggcctgtgattcctcacactgtcaaaaaacgcttcaaattccaaccagtccatcccgtcatgaccgccctggatcccttcggcaagaaacttcttccaggtgggatgttcatattcgctctcataatccgcagcatttccccatctctctttccatttaaaatcatattccacatcttttttatccaggaaaacagaatcggtggcctcttcatacattccctttgtcccgcatactgtgaaatcccggctgtagaatctgggcagtgtggtgttgagggtgagaagaatggtttcacctccggcgcattttatggtggtattcaccacatctccctgggaaaatcccggaatttcctgcccgcggtctgtcagatattccaaaagtccctctgcttttgatgccatggaactcagagtcagcattcggttgcccctgttgatattaaggatctgggctatggggcctaattcatgggtcggatagttctctgcgttcctgtgtatgtaatttctcaggcggtaatggcggttttcttctccccctgcaatctcttcacgcaggtcatggagataaccgcctttgcagtggacgattctgcccaatacacctttttttgccatgttcataaccatcatttctcttctgccgtaacagcagttttccagaagcatgaacggaacctttgtggcttcccaggcatccaccaaatcccagcactgtttgatactgtaagcgcctcccacttccatgcctaccgccttgcccgcgtacatagcttttacagcaagaggaatatgactctcccaggcggaggatatgacaactgcatccacctggctgctgtccagtacctcctgcacatccactgtggtaagcggcgtttttcctgtcttatttttggtaagctctgccgcagcctgcgccctgtcctcatattcgtcgcagacggccgtgatctccacatccgccatatgcagcataacgtcttttaaaagactgtatcctctgcatccaagtcctattacccctactcttagtttttccatctgaacggctccttttcctaatatattatatattttctgctttgctctttctatatagttgtaacatacccgtatgcagatttctatatggttttggggataaaatatttgaatatggataactttttatcactgccctgattcccggagaaaggatgcgggggatctgcctgtgacccgcttgaaaacagtgctgaaataattcctgtcacagaatccgaggcgctctgacgtctcattgatccctataccgtcttccagcatttccatagcatgtctgatcttcatctgtgtaaaataggtcatgattccaatgcccgtatattttgaaaacgtttttttcagagaagcctcactcatgctgcataatcctgctatgtctgcctgggtcagtctctcctggatatgttcctccaatgtacggacaatatgtctgtaattgtcagcactgatggattcatagtaatccattttctgtttttttccgttcagcacagacagaagaagattttccgcagtattgataaaaatctgtgcctctgcctccctgcccgtgcgcacactttttaccagggtatcttcctccctgtcaaaaaccatagctgccgcatctctcaaaattgaaatggttttatggttctcctctgtcaattgaaactgcttgtcttttacctgaggcatggcatccgcggcaaaggagatcacaaaaatatggggttctgtccttccttcggaccacaggcggtggaattccataggccggtgcagtacggactgtcctttttcaaggatcagtatgtcttcccccgccgtcacacccagagtcccgtccagcacacagacaaattcccagaagtcatgggactctccctcaaaataataattcctgtcgaagatttcctcaaaaatagtaaagagagacgtgatactgatatatttactgaccgcacatccctgaaagtatcttctcatgttttttctccttaaatagctgataagataaggttaaaattcagatcataaatttattttaactttttttatttcttttgtataggatgtttgtttccggtcatactataagtagtccacggagggaaggcacaaagatgtgacgctcttcgaggatcacaaaagaaaaagtagaaatacttatcctcccctttgaagcctctgtaaccggaagaagcccaccggttacaggggttttacataatgtgaagtgctgaagtgggcctaaaaactgctgtcaaactgctgtcaaattgccgtcagaattatggaacccttatgtttcctggggtaaacgcgaagtcaggagatttttgaaccgtaaaccgtattcagtgttttccgtaccgcatcactgccgcttcctgtagctttatagtaagctgacagagtaatgcctgtgtccctgtgaccaaggacctgggatacatcactgatcgcgactccttctgatattgtgatcgtcgcaaaagtcttacgaagtttgtggacctttgcatattcaatccctgaaaaattcaaaagtttttcccatacatcataaatatttgattttgtaggcacattctgttttttattgcacagaacttgtccacacatacggttcgtctgtatataccgttttttcagttcaagaaggcattcttctgtatgttcagtcattggaaccactcgatagaggtttctgattttggaagctttgtatagtagatttttcctgctctttttccattttcatcatatttatagccctcagctctttgtttattcacttggatggtatgatttgtaaaatctatgtctgaccaggtaagcgccattgcttctccgatccgcagccccgtgtatgccattactaagaatatagggctgtatataaaatattttttacaattccaggattccttgatgcctctttccagttttttttatcatcataagataaaatttctttctcgggatcctgccttacacattttttgtacggtatctccatttcctccagtggattttcttccatatactttttcttttttgcccttataaaagcccgattcaatatagtgtggatcgttttaatggtagactttgcataccctttcccaattctttctttaaaataatccagcatatcttcttctgttatcagatctagcttcatctgaccaattttactgccttttatgtgtgatctgtaacaaccataatacttgtcatatgtagtatcctctttgactcccagaacatatgtcttcaaatactcctccatatattcctctaaaacaggaacctttttacctttcttaaattccacctgaagaatataattatggaggacctcctgctctgtagctccatacacgggatagcgctttcttgttgaggaaacagacgccggtactgtcatcatccatctgttctctttctcacgatatgtcgccttaggtatttttatcatattatccctcactttgtgaaggaaaactgtcatatcctttgcattaattatatcgcatatgagaagatggctcaaagctaactcaactttgctcactctgtctgtcatgagcaccatcccttctctacataaatgctacgcaactattcagtccaaacagaatcaccatttgcggtagaatcttttcccggctgccaagcgtatttttacaatcagcatagtaaatgcacagatttgtcaaataattttattgctttccttacaacttaactcacctatgttttctcttttgaatccctacactgacagctagtgcctgatcaatctttttttgtgttcttagagatgtgtttccaatataccccataagcctgctcttatctattgttcgtatctgctccagcaaaactgtagatttcgatttcaaagatgagtattttggaaacattacatgcgtcggaatttctgcttttttactcccggtaatcgcagctatgatcactgtcgggctgtatttattccccacattattttgaataataagaaccggcctcacccctccttgttctgaaccaattgctgttcccaagtctgcataaaagatatcccctctcataatcttcttttccatctgtttaccccatttccaacattcacaatatgtatcgccagctttatttatcttaatcatcttaagctgacattaggttattctaacgaaatcatcaaacggctgactgcggatcagctccacgggcacttttaccccggtcaggttctctgaccgccgccctcattgccggggacgctcttaacgctcggactgtgactagacgggagtatcattgtccccattgctggtcatcgcctcgccaggagcagcctggcttcatccgtcttccagaaatcgctctctgtcaaatataatacttgacaggtcttcgcgtggtcacggaacagctcacatttaacatacagacaatgggaatgtatttgatgaacggatattttattgtcaaggttcaagcctattttctttaatacaatattttacatttatctaaccagaaaataggtaagagatttttcctcttttacctatttccacactcagacgtcaaaaacgaagcctattcttcaaatttttttaactttttttgaatttttttttttctggctgcatccacactgtgctggactgccctgcttgtgcatccttcaatcctggcaatctgttcataggtcatatccatctcatagcgcatcagaaaccgtcttctttgaatggatggtaattcgtctatacctatcctgagttcttccatccgcatctttgacagtatctgttcttccagactgttttctgaatgcagtgccctcttatgcttcattccttcagatagttccaattgctccaaatgccgttcatccgaacggatgtaattccgttccctccgcatcagacctgcatctcttcaaaaacctccggggaggcttctgattcctgccatatcccttgtccatcatggaatgaaacataatattttgtttcttctcctatgtgcttttcataaaatgtataaattcttaatgtatcttccaaaaccctttcctccaatctgaattattttgaaattcagatcagagggaggggctctggctttatatgaccattgctcccaataaaaaaagcacaggcagatataaacaatctgctgtactttttttacatttgatacagaggataaattacgacaaaattctacatggtataggtcagaatttcccgctaacttgtcttgtcttttttcttattatattataataaaaaaaggttgtcatttttgcgtaaatcttttcatttatattctacccttctgctattattatttaaaccagattttcccatgtcatccgcattattcatctataattttcatttccagaaaaaaaacttctctatgataatgtttcacctacatctcataaattaccatttcttactttccaacatgataaaaattaaatcctgttttcatataaatatctaccatatgaccaaacttccttttgtcaatctctctgctattttaagtaatcttcatcaatttaaaaaactaatttttacacattaatccctacgctcataatatttttcacggtttttacaatagtataatcatctgccataaccattaaaaaacaaaaaataaaacctttctccacaatatttcaactatgtcaaaaggtttaatttctctgttacttatatagtaatcctattatccgaacgttttgataaggtcaattatttaccacatttattggtttaccatcgataaatgccttcacatttgcaatcgtaatatccataattctttgacgggatgcctgagctgcccatgagatatgcggtgtgatcaaacagttcctggcttttagcaaaggattgtccccttggatcggctctgtcgaaaccacgtccagacctgcagcatatacttttttgctattcaaggcctctgccaaatcctgttcaactatcaactgtccgcggctgttgttaatgatgataaccccgtctttcatcttagcgatattttctctgttgataatcccctccgtacttgggaataaaggacaatgcagaaagattacatcagcctctgcaaacaacatatccagtggtacatattttgcaagttttctcccagcctcactctcaaattcatcataagctaaaaccttcatatccattccattcagaattttagctgtggcctgtccaatacgccccagtccaataatacccgcagtctttccatatagttcaatcatagggtaatcccagtaacaccagtccgggctgctctcccattttccggcctttacggtttggtcatggtgtccataatgagaacatatttccaacagcaggcctactgcatactgaccgactatttgagtgccatatgtaggtacatttactaccggtatccccttctgtttcgcatattcataatcagccacattatatccggttgccaaaaatgcgatcagctttatattcgggcagttatcaatggtattcctggaaataggggttttattggtgataacaatctcagcatctccaatcctttcaatgataactggatgctccacatatgaagttctgtcatatacagtaacctcacccaacatttctaactctttccaacttaaatcgccaggattttctgtatagccatctaatacaacaatcttcatacttatcctcctttgttttaagcctgatcttcgaccaacgcccaggctctgttcagcactctcttagtatttgccaaaacgatctcctcgtcctcatcttcaatcggcgtaacttccattgataaaaccattgggtccccggcattaaaaaagccttcctgtttcagaaccgtcaggtactcgacaagctctttggtatcatttgcgctctcacaaaaaccaaatctcggatgtttatcaccataggctatacagccttttttaaccacagcattgccaaaatgaagatgggtaatataaggccgtaaagtctggatcacaaactttggggattcataggtcgttggtatatgagacagatctaccagcaatccaaaattattattagtagtcctcatatcagctgcaaactttgccgcataaggagccggaccgatcaatgtagctttatccatatcaaaatcaaacacttccagctcaaccaccatattcctagccgccgcataatcacaaatattccttgtggtctttaaaagctgcgcatatgccaaatcttttgttgattcttcccatttcccggccagaaaagcgattccctcagccccaaggtattcagcctcgtcaatggcttctatcagcgctgtctctgctgcctttctgccttcctccactaaatcatttggattcaatttacctccgagaagcctgggctgtgcgccataacaaatcttcatatgagactgtgccaacagattcttaacagccttacgttcttcctcatctttacaaccggaaatttcaatcacatcaaaataatcatcgatcgcaatcttcctgacagactccagaacattcgtcttaggaaaagacatccatcgaagcgtaccgatttgaaaatacttatgaattgaatctttcatccctactcactcctaatccatgtttatatatccattgataatatctaccaactaacgtcatcctgtcaaatgacagacgattcattttaggcaggtaatttcataatgatcttcagatatcttttcggtagttctttatgccggcacggcatatgtccatcattcgggaacgcaatatagcacattcctttcctaacgggcagaaatgctggttcttcttcatactccagaaactctatatcgtctgcctcattatagggcaccacagacttcatgcgtctgaacggtgcatatacaacctcctcgccgccttcgatcaaatactgaacatcaatatatttccggtgtacttcatagctatccttttcatatgctttcgtctcacctctctgcaccaaaaggaatcccccgtcataatcatgacgtcctgaagggaattgttctttccgcagtttttctacacattctaatgcgtgttccaagcattttaagattgtttcataattcttcagttcctcatattcacatataatcattctaatactcctaaaaattttacagtacctgttcccgaagggtcttgaccgtctcttttgctccgttaatgatcataccaagctcacttcccatattgaacaggttcatgccctgctgcctgccataggaaagatattccacatttgtagatacagtaccacaactcttccccatcttaatggctgcttcacatactcttacaactgcctccttcatctctgcgcaatttgattcccccggatgtcccaaatcggcagacaaatcagatggaccgatcactaacgcatcaatacccggcaccgccgcaattgcttctgcgttatctactccctggcgtgtctcgatctgagcaagcaggatggtccttgcattagccgtctccatataatcagcaagcttcggcggaacataaccggtgtgggcacgcattgtagataatccgcgctgtcccaaaggggcgtattttgcaagactgactattttttctgcatcttctcttgtgcttaccataggtatcagaagaccatccgctcccatatccaaaactttggtaatccactctcttgttatcaagggaattctgacaagcactttcaaatctatgctgttgctgactgctatcatagctgcgagctgcgaaaagtcaaacggaccgtgttcacaatcaataataacaaaatcaaagccactctgtttcaacatgcggggaagattcgcactggtgatttctgaaatcatggtactgagtacatcctcccgattttctaatttctgttttaacatctatttttcctcctctgcctgataaaacattctatctgcttgttcatccaggctgctgcatatgccggctgccgcaagactcaaacggaacatacctgccaatgcctcatctttcattggtgaaagcctggtatcctgcccggtaacctctgcaatggctgtacataattccggagtcttccaacacacaccgcctgcacatacaatcccgcggatattttttacatctgtacccaaatcctgaatatggtgccaataagtctgggccatatccttaaaagcggcggtaaacaaattatcgatactcagattattttgagtaatcccggcaatggcaccaccattacaataaaatggatttttataaaaacaagtctgcactcttaatccatcctgcttttcttctgcatgttcatggatatatttccaaatttcttgcttttctaaagaaatccctgtcaattcatgtacactttcctgcaggaacgttacaagcacatccagattacgtccgcccggcatgttagagatggtattcagatatcccccctgaaaatacggacgaacctcatacctgcccggcttgaattcccgctcatatcggataacctgagcagcggttgccacattgacagctacctccccctcctggatcctgcttcccaaaactgctacctgcatatctccatagtcaggatgtatcttcaggctgcatgtattgcttttgtatataccgcatacgaaaaaatcgtgctctgcgatctcaggcatacggattttatcaaaacccagtcgctggatcaacttatgatcccagcaatgatgtctgacatccgccagccctaaaggagcggcattgctgatatggcatatattattccctgtcagctgggtgatcacataggagcccagtgtatataaaacaccgtcctcaggaatatccgtttcatgaatcaaggtatatagattgcacaaaccaagtgatggttttatgtaaacgccattattctccatatcctgcgccggtacttccttctccagccattgaatataggtctgcatgtcatctttcatatttcccatacatcgcatatcctgccaggaaatatacctatcttccctcccgggcacactatagacaaacccatgcatttgcgtagaaaggatcacgccctctatatcattatactgtgatgtgtatccatctatcagctgtttgatactatcactaatctgcagagccggtatctcaaataatagggaatcttgcccctggatttttttcggggatgggaaactccggctatctgtgattcggtcattttccaagtccaataaaacggctttcagaaaactgcttcctacatcaattccaatgtatttcatagatatcgcctcattatctctttcactgtttattgatttcgcaaggtattcagagcgatcaacgcatccttcatagttgctactgctgtatgatagcgaatatattcaatgacactttcatcttttgccatcaaaagctctgttattttatgatgagagtcatagtaatcatgttcattcatgttcagatccaatgttgcgttgatccccataatactggataccattggcttcaatgtataatggcattgtgacaaagcacagttccctgccatctcaaaaagtctgtcatgaaaatcatcatttaactgtacgactctggctcgctgttcttctttatcatcaatctgtttcacggaataaaactgtccaacaatatgcaaaagttgtgaaaaatcatttttctcctgttgaaggatcaactgcacagcctcacattccagaatgcttctcgttctgcataaatccttaatatatttatcatcgatttttttcagaacctttcttccattgggcagtgcttccaaaagtccatcgcgttccagaatctgaaatgcagaacgtacagaactgcgtgacacctgatatttctgcgacacttccaactcgctgatttgttttgtattctcgtatttacctaacagaatatcatggcgcatccctgtaagcacggtagccacagtcgcctgtctgctgacactaacatccaacatattttttcactcctaccatttatattgttgaaaatggcatagggcaatccgtaacgggtacagtctgccccatataatgccttctcaaaagttattgtactataacttttataaaatgtatatttattccatatgactgcctatcctatttgtttttctcaatcgctgtgctcagggcttcatacagagcagggtttactgtattctggatatcggtccaggtatcctttgtggcctcacggcatttctccagatcctcttctgtaaactcatatacttcatattcatagtctgatttaagcgtttccaaactcttctgatcatccttttctcggtctgcttcattctcctgcgcatatttacatgcagcaatcaattcatcctgctgctgttctgtcagcccattataaaattccagattgatcaaaaatggatggactgtcggttcatgcttgctgagtgtggcataattggtaacttcctgcagattataattggctaatgtagatgttaccgtattttcctgtgcttccactactccctgctgtaaagcagtgtagagttcggtaaaagcaaccgttgtcgtattagcgcctaaagagttccacaggctgatgtgatatttgttatccataacccgcagctgcagccccttaatatcctcataacaggtaaccggtttttttgtaaacaaagtacggaatccctctgctcttagacaccccagcttcagatttttctcagccagcaccttatccatcgctgcttctaactcttcatccgcgcatactttcctcatctgccaataactgtcatatgcaaatggcagatcaaaaaggcagaaatcacttactacattcacatagcttccggtggaaccggcaatcatctgtacactgttgtcaacaatgctctctgcaagctctgtatcacttccaagctgtcctgcaggatagacctccatttttaaatcatctgtatttttttcaaggtaatcctgtattgataagaaaaactgtcccagtgtagattcttctgtacttgcatgtgctgcgataaaggtcgtagctttcgatgaagatgcagacttacttccttcagaagcagtttttccttctgctgctgtatcagatgatgaatttccacacgcggcaagggaaaataccattgctgttcccaccagacatgccattgtttttttcaaatacctcataattatcctcctttttataacacattctctgaagttttccgcacatcacagcaaacagaggctgatagccggaacaaatgtaatgactaacagggcaactgcaaatgccaatataaagggcagtgcatgtttgctgagtttcataaccggaacaccggtaatacctgacgtgacaaacaagtttatgccgaccggcggtgtcacaaatccaatggccaggttgcacaccataataataccaaaatgaatggtactcattcccatagcctggcagatcggccataaaattggcgcaaaaatcaagattgcaggtgtggtatccatcacacatccgataaacaaaagaagtacattgataaacaagagcactgccactttgccggggaatgatgatagaatgaacccggatattgcatctgtcacttgaagcagtgccagagcacgtccaaatacggaactaactcctactataattaatacaggggcaatcgaacccagagactctttaatgatcatgggcagttctgaaatcttcagcgtccgatatacgaacagactgataaccagtgcgtatactactgaaatagttgccgcctctgtaggagtaaagataccactgtaaatacctcccaaaatgataaccggagccaagagcgccaaaaagcttttaaaaaacagatttccaaagctcttactgtgtaaatccttataattctcttccagtttcttcatatccgggggatttttcctgcaataaaagatgctgtaaataatcatacagagggcgatcaagataccgggaacaacgcctgcaatgaacaaatcacctacggatgcaccggtggccgagccatacatgatcatcggaatacttggtggaatgattacccccaatccacctgcaactgctacgatcgcagctgcgaaagacaggctataccccatgccagtcagcaccggaatcgtcattgcacccacagccgcagccgtagccggcccagagccggaaatagccccatagaaaagacaggttacaatgaccgttataggcagtcccgcccgaaactttcctataaaataggaaaagaaattaaacaattttgctgcaattcctccttttgccatgatctgtccggataaaataaacagtgggacagccaccaggacgaaggaatccaaagatgcagtcatagcctgaaaggtataggccggatttgtcactatggaaggatcctgaatccagatcataatacaggacactccaatcgacaccacaataggtactccaagaaataacagaataaagaatgcagccaaggaaatcaatacaatactcatgtggtttcaccccctttttttactatgtagaatcgtttcacgtacttctctatcatcctaagtgcagcaaatacaagtcccagttccatcatcagataaatataaaacatagggatttccaggactgctgttgttgcctgagatatcaatgctgctttcagttttgtcattccatgccatgccataaatatacagaagccaaatacaactatatcgccaaatactgccagcggctttgtggtcttcggccagaaggtctgtataaggtccactctgatatgcttgtcggtctgtactccataggaaatccccatagctgcaattatgatctcacaggttctggaaagttcctgtgcacatgtaatacctgtgccaaaaaaggaacgtcctattacatctgcaaacacaatgacagtaatcgtgactatggcagcccccataatgaccagttcaaaatttcgatccagccactttattaacttcataaatgttccccctttatatagtgatctgctcaacttgcggatcgtgtctgagaatagttactatacacagtttctctgcaggtttattttttctttgcattcactgcatcgtaattcaaacaccaggtcggctttttccctttcaagatttcaacaataccacgtgctccgtcataactcattctagcaagcgattcatccgtcagcgcagaacagtggggagagagaagaacgttatccattttcagcaggggattatctgcctccacaggctctgttgcaaatacgtccaataccgctcctgctattgttccagtgttcaatgcttcaatcaacgcttcttcgatcatcagggcaccacgggccaggttcataaagactgctgtttttttcatcatttcaaactgcttctttcccaccatacctatcgtcgaaggagtggcacccaaatgcagtgtaacaaaatcagcactcttaaagatatcgtccatattctctatgtactgaatataatcaggaagttgttccttatctgtaaacggatcataaccaagcactttcatgccaaatccattggcggcgatctttgcaacccggcgtccgatattccccaaaccgataattcccaacgtcttgcctccgatttcatgcatgcccccgcagtcctgtgctgcaaaatctgcttcctgtgttgcacgatgcatcttcaccgtcttctgagaaatagcaagcatacctgcaatggtatgttccgctacagaatctgaatttgcctgaggagtattcactacataaagtcccaattttgttgcggtttccaaatctaccacattatcaattccaactccatgttttgccactactttcaagttcgtgcccgcttttaaaatctcctcatttagaaaaaaagtctttgaaaaaacggcttcacaatcagcgattaattttttcatcacttcttcatcttcttttagagccattactaattcaaatccttcctccaccaacagattttttcctgctggatccatatcctgtgccatcaatacctttctgctcactctaattgacctccatcttttcgctttccgtatttgtctaccgttactctaaattgtcgacatttattgtggtttaagaatactacatcgaagcatatttatcaactattttttgtatttataataatttttgttaattacaaacaaataaaagccatctaatttgtggacttttcctctgaattgtcgacattatcgtttcaaattttttagcaatgcatttaaccgcaagaaagctccggaagcattgtgatccaaaattatcacaatgcttccggagccttctaaattattcttatccggactactgtctgtttaatactctgtcatcatctgctaagctctaatctaatcttcctgccagttcttggcacctgtataccagcatactattaaagaatcaatatattaatcaaatctaacaattattttattattagtctttccttccacaaaggcttcaaatacttccggcatctcatccatggtaatgattctgcctatcaggggtttaagatcaattccccctttatcatggctattgactgtgacatcgttttttccagcgcataagagcctatcagtttcaaatctctgtaataaagatcaaagggattgattttcatctcactttctgttggacaagcgccaaaagctacataggtgcctgtatctgccagtagccgaattgccatttctcctactctcggtacccctgttgcctcaatgatatgatcaaagcctctgggatacattcttttcaaagtatcctcaactttcgcatccgaataaatcacatcatctgcccccagttctttggccattttaagctgagtttcttttacgtctataacaataattttacccgcgcctcttctctttgccatgagaagatgcatcagcccgatcgtacctgctccgcagattaatacgtcagcacctacagggatcaaagctttattatgactgttgataacacatgccaaaggttctaccatagccccttcaatagggtccagaccttcggccaaaaatacacactgctcaggaactgcgacatattctgcaaatgcaccgtttcttgtatttccgatcacctcaatatgttcacaatgaatctgtttattttgtttacagtaatgacatttttcacagaaaacattgggatcagtgataaccagatcacctattttaaattgtgtgactttttctcctatttctgcaatcaccccagaaaattcatgtccaggtatgattggataatttgttacatgttctcctttataagtgtgaatatcagtcccacaaaagccggctgccattacctttatcagcacttcatcttccttgggaacgggtctgtccacctcatatacacctgcttcgtatggattgctaattacaaaagctttcattatttctgcctctcatttcatttatgtcttgtatgatacctgctgccgtaagaagacaactgagagcaccgccgtcttcttgtactgatatcactatgatcctaatcaaacaatgatcacatttgcgcctaaatcttttagttcccgcaccttttcctcaggtaattccgaatctatgataataccatcaaattcatccacactggcatagtgaagcagactctcatgtccgtacttgctggagtctgccagcagatattttttccttgctattttcataattgctcttttaattccaagttccgctacatttccgatatagacatgtccatcctgacccagaccatttcctccaaggaatgcaatctctacacgaaattggctgatttgctgttcagccagcgggccagccgctgagagtgtgttccttctcagattaccgccgatcaaaaccacagagagtttctgacgtttcaacatttcagatgccaggttcagtccgtttgtgatgacaatattgtcttttccattgtcaatattctccgccataaaatatgtggtggaaccagaatcaagaaaaattgtctgcccatttttcacaaaagacaatgccttcatggcaattcttttcttttgcgcctcctgggataccactctccgctcatagggcagttccgtgctttcctcaccggtgggcagcatagccccccccatgtgtgcgcactatatggtacatctccgaaaggctttctaagtctcgtcggatagtcatttctgtcacattgaacatcttgcccaattcacttatttcaacctgtccgtctcgtttgatcaactcataaatctgctgaatacgtttttctttaagcatataccggccccttttttcatgcaattttagatacattgattttatcacattttaagatatccaaagcaaaggaatctttgagccttcggatgaattattccaggagtatctacgtgactgtcataacaagtatactggtaaattctccgttttaaaagagcgacaaaaaatccgggttgtaaatcttatccgctcttacatctttacaggcgaggcagatacctcaagaaaaaaggggctatccgttagtgacagaatacagacggaggtatttagaaaagaacttgataagtttgttatgtcgttaagagcagatcacctacagcctaatacaatctgtacctatcaaaggatagccgcatatctcctgatctactgtgaagaaaaatcctatctttcagtcacagagttatgttctggtaacatccgggattttatcctgtacctttatggctgcggttatttcaggccgacttctatcaccagcggtctctcaggccttaaaagatttcttgccctttatccagaaactgaacaccttatcatggaattaccatcccgtctccctcgtgagcggaacatcttagaaatatacagtaaagttgaaacggacgccatcaacagcgtactgtctgatgatagcctaacgaaacgggataaagctgtctgtctgttactgctggaaacaggattaagagcggtggatgtctgtagtatcaaactttccgatatcgactggaacaaagatatcatctatataaaacaacagaaaacaggaaagccgcttcatgtcccacttcgtaaatcctatggaaacgccattgctgattatatacttaacggtcgcccggcatgtaagtcagaatacctctttgtcagggaactggcaccatttacacgcttaaatggtgaaggctcctctattagaacaattctcttaaaaatggaagcatccgcaggcatatctaataaaaacaggagttccggcagccgaagtacaagacacaatgctgcttcgaccatgctcagagcaggagtccccatggcagatatttctgcagttcttggtcataaagatcccagcatcgtatcagtttacttgtctactgatgatgagacaatggcgtcatgtacgctgccgcttccaggaggtgtgcgaaatgaataaaacattaccagacctgatcactgaatttctggagtataaaagacagaatggttttgtctatacaaccgcagaataccatctaaataaatatattgattttgcatccatccacgttccgcttgagagcataccaagcagaaagacggtaaatacatttttaaacaggtattccggtactccgggaaatctatataatgcggcagctgctctccgagagttctcaagatatctgatcggacttggatacgcatccgcatacgtcatccctgcggggaaaatctccctgccgatacctgtcagaccatacttatttacagaggatgagatcacaaagttctttacggcatgtgacagcattccatatgactgccatgttcccaaaaggcatctcgtgctgcccgcaatgtacaggctgctttattgctgtggtcttcgctgcaaagaggtccggactctcagacgagaactggtgcatccagaaacgaattatatagatatcatccagtctaaaggcccaaagagcaggcggctttttatttcgcatgaattgtctgagtatctcagcgtctatgatacaaaaatagatcatatctttccggacaggatatttttcttcccttcccgggaagatgctccttatggagccagtacgttccagaaaaacttcttaaagatctggtatacggcttttccagaaaaactggggaatggggtgagtattcgggcgtatgatttgcggcaccacttcgcttatgcaaatatgaaccgctggcttaaagaggggaaagatgtaaatgttatgctcccttatctaatgcggtatatgggacatcaggatatagaacacacgctttactattttcatcttgttcctgatatttatcatacagttgtggaaaaagcttccctttttgaggatctgttgccggaggtaagtgaacatgcgtaaaaaagtgacagctgaccgggacagttcttttttctggagcaacgcatccgagttcctaaacaatgagctttcttgtattcgtaagaagagttccaatacggtagaggcctacagactgtccctgaatggatatattgattttctggaaagtgagaaatccattaaacgaaaagatatatgttatcaggattttaataaaaacaatctgaaagactatctaatatttatgaaagattcacgcaaactgagcgaaaagacatgtaatctcaaaatgactgcaattcggacgttgcttgcgtatgctgctgaagaatccattgatatcacaacggtctatgtcaatgcaaagacagtaaaaggtctcccagttcttcaaaaggagattgaatactttgaaaacagtcagcttaaggcactcctggcagcaccatcagtggatacaaaaataggaagaagagaccggatgatcttgatccttggatatgatgccggtctgcgtgtcagtgagctgacacgattgacagtatcctcactccatctgaacgcagagactccatttgtgacgatcctgggaaaaggttcaaagtacagaaatgtgccactaatgagcaggaccgtacatcacttaaaggcatatatgaaagagtttcatcctgtaataaagatagagatgcctcttttttatacggcaacgcatggaatcagacattctctttctgatgacactatacagaatcttttgaaaagatatacgaaccagagcagaagcaggattatgatgccagaaaaggtccattttcatatgctgagaaaaaccagggcgatggatctttatcaggcaggatgcccgttatcctatatccaacagctattgggacatgaaagtatatcaaccaccagcggtttctatgcatttgccactttgagaacactggtagcttctattgaaaaagcgaatccatctggagaagaagaaaagagttggaaaaaggattccgtattaaagcagctttacagactataaaaactatgccgatatttttcctaagattcccttgtttacaggaacttcttgaaatatcggcatagttattttttcggtataagtcgtgttaagccgatatcggcttaacacgaccaatgccatagaatccctgaattccacgtatcggaaattaaaccagcagagaagtgtatttccgagcgatacagcgctgctgaaagccctgtatctagccacttttgaagcaacaaaaaggtggactaccaccatccggaactggggccaggtctacggtgaactgagtattatgtatgagggacggcttccagaataaaaaacagtttggttaaaacaggcggaaaagccgcctgctattgacatgccatcctctggatggtatatataaaacaaaggtggaatacctaatttctaagcattccaccaagtcttatcatagaagaatcctatttacagacttttcttcataccctcacttacgctgatctcctgtggttttaatctttacaaatatcataataaaagacagcgaaaagaataagcatataaaatctaaggcttatcttttatatgcttattaagtgtacattttttaccaaaaaatcagttatcattttaaataatagatataaaaataaagaatcgccaaaaccagcaatttactggaactggcgattcttaaattatggagtttttttacagcccccattttgaactacctacttcccaacagctccgttattttttaaatgagccagccaattccgtgatattcattgccccaagggagaataaattgttcgtttgtaggtctgaatgggaccatatcccggatttcatctaatcgtttcaagatatcaactgggagtggacctttttctacagcgttccaattactgataaactcttctttggaacgagaacctgtcaatacgcaatgtaccagaggattggatactacaaatctcatagacatttcgatgatatccattcctgtttcatccagtaagcgatacagggctttgaactgttccttacggggagtgctgatccatggtgctccattctcaatgatatcgtcccggcgaacagcaagagacccctgctgcaatggagagccacagattacacccatattgtgcttcttggcaacgggaagaatctcatattctgcctccctccacaacagactgtaattaaatgcagtcagtacacagtcaaagtgtccagtgtccataattttggcaagttcatgagtacaggtgcctgccacaccagtgtattttactatgcctttcgctttcaattcctccagacattccatcactggtccatcgtaggtctcctcgttctcccaccagtccatttggagacggcgttctggttcgtgaataaagagaatatcaatatgatcaattccaagtttctccagactgccctccacagatgccatgatatcctttttagattttggattccatggttctggcattcccagcttggtggaaatcagtggtttctttccttcataagattttaaaatattaccaaggacagtctcactgttaaaataagaaggtgccgtatcaatcagccgtacaccagtatccaatgcatactgtgtagcgattttggatttctcaaaatcccctaccaaatcagacataaataaaccgcccagcgataatttagtcacttctaaatccgttcttccaagttttactgtttccattgttgttcctccattcattctctcattttgttgataatttgatcactgctttaatcgccttcttctctcgcacgtgagtatatgcatccggtgcattatcccaggtaaaaatgttctctttatctagccagttatttgcatccagtttaccggctcgaatcaattcaatcacctctttatgtgtctcagcctcatcataaactcctgcataagagttataaaagcggaaagatttaggccctaaaataggattaaatgtatagctgtaaaaatcattcatgccgtatactgcaacggtacctccctcctgaagcatagacatataaggagtcaaagtctcttttacgccggttgcatcgatgaggtatgcatacgaagatggattctcccgaatcagcttttctacctcatctttctccttgtaatttacatagccggcaatcccggttttcatggaaggcactcttcgtttctcatttcctacaacagtcacctcaccgccgcggatcgcagcacaggctgcgatggaaataccattggcaccggatcccaccacaagaactttatctccctgtgatactcccatgcggttgatccaggaaaggttttctctccaagtaatgatcatggtggcatctataggatcgatcacaccctcgggtatcacctgattcacccgatatccatcccactcggtctggtcaataccgtctgcccacattgcctcatggtccacagccaagccatattctgacattcctccccagctcagccctacaccatcagtctccctggtatatactctagaaatcaaatcacccactttaaaattgcgtaccttttttcccacttccacaactctgcctatggtctcatgaccaatgatagagggatatacattgccccaggcaaattttccatcgataacactcaaatctgttcccgcacaggtagctccatacagattttcacaacgggcttcataatctcccatgggtggttcacttacatccatcacctttaaaactcccggcttttccacaacaagcgctttcatacttctacctcctattatttattaagttttgttttatttcttatgtcatagaatttattgcggattaacaacatacattatccagatatccttaatttactgaaactcggcaatattattctcatcaattaaagtccagggaatgatatattcatcctccacagcttcttctccatcttcaaaatatgtctgcatcacttcaacagtctttacggcaatggcctctgcatcctgaagcagagttgccttcatatcccccttggcaatagattcgatagcacttggaatcccatcaatccccactacaattacgtcttcacatgacagtccctgtcctttgattgcttccactacaccaattgccatttcatcattttcacacaccaccgcatccagtgtagtattctgaagccaattctctgtgatggacatggcttctgctgtcttccaatctgcagcctgactgtcaaaaacttttacatctttattttctgccaatacggtatctattcctgctgtacgtttgatctgggcgtccaatccatcaggaccacggagaatcccaatattgccagaaccactgatgcatttcacaaggtactccatcagtgagactcctgcagtagtatcgtcacaccctacgtagcagagagcttcatccatgttgtccatcatacagttcacaatcatcatagggattcctgcatcctttgcatctgttaccaccactccacaggcagcagcatccaccggactcataagaatcatatccacattctgtgcaatatagttgctgacctgctccacctgcagtcctgaatctgaagatggatcagataccagaagtttacatcctaatttatccatttcctccttcagtgtatctgtaagcgatacctgcaattcattggttaagttagccggagaccaagcaatggtcataccgctatagtccactgttcctccatctgtcgaaaccgtctcctgcgcatctcccttttctgtactttccaaactaccggtatcttcctgtgcctccccgcaccctatcatggtgaaagctgtaattgtcagaaccattgccattgaaatcatacgtcttttcatttattccttctcctttttagctgttttctaaatatcgtatagtaccccttttagtcaatctttcttatgcttggaaaccttcacatctacaaacactgcaagaataataataaatccctggataatgtcctgataataagattggatattcagcatctgcatcccattatttaaaaggccaataatcagaacgcccactaatgttccccacatattcccgacacctccggaaagactggttccacccagaactgctgctgcaatggcatcaagctcatatccctctccagcaatggctgtagcagtcttcactctggcagaaagtacaattccagcgatagcggcacacaaacccgaaataacgtacacagaaataatcagcttcttggtggaaagtccacaggctttggcagctgtctcattgcctcccacagcatagatatatcttccgtatctggtcttcttcagcaccacagctcccaccaacagaatcagcagaaaaataataatgggaaacggaatcaatccaaataatttacccgctccaattatgttataggattcctttaaattagagaccggagaaccgttgttgaacaccagagccgcacctgctgccataagctgagatcccagtgtcacaataaatgcgggaaccttaccataggcaaccagtgctccattgaacaatccaatagccaacccgatggctactgccacaatgataccgacaatgggcggatagggacttcctgtagtcacaaaagaacaacccacaatagctgaaaatgacaggattgatccaacagacaggtcaattcctcctgtaataagaacaaatgtcatccccactgcaagcattccattaaatgcacattgacgtagcatattaagaatgttattttgagtcagaaaattgtcagataccacactcataatcaagaacattacaataaaaataattagtacacgaaatttcaacaaataatataatatacttttatcttttttcacaattttagtccccctttcttaaagcccagatgccgcagccataattttctcctgggtagcatccttacggtcatagattgcagccatgtctccttcgtgcatcactacaattcgatcactcatacccagcacttccggcatctccgaggagaccatgagaatacaattgccttccctcacaaattcatccatcagccggtagatttccgcctttgcccccacatcaatccccctggtaggctcatccaggattaaaatcctaggctgacaggaaatccatctggacaaaaccactttctgctgatttccgccagacaagtttccggcaagcttattctcactgtcagtcttaatttttaattttttaatataggtatctgcaatttgggtttcttctttactcttaatgaaaaatcctcctctgcaatactttttcaaatttgccagggtaatgttctccttcaaggatccaataagattcaaccccacacgcttcctgtcctcagaaacaaacgcaattccatgtgaaatggcatctttgggttttcggatttccacacttttgccgtcaattttaatggttccactgcttttttcttccagaccaaagatagtttccataacctccgtacgtcccgcccccatcagtccagccaatcccaatatttcgccttttctgagggtgaaactcacatttctgaatttatcctttcgggtcaattgatccacttccaggatagcatctccaaactcatggtctgtcttataaaattgctgttccagagttctgcctaccatcatgctgataagtttgtcattatccaggttttttgccaggtcagttcctgcaaattggccatcccgaagaatcgtgatttcatcggatatctgaaatatttcatccatcttatgggaaatatagacaatgcctttcccctctgcccgcagatcatcaatcacctgaaataacttttccacttccgcctccgtaatagccgatgtaggctcatccataatgataatatccgcattgatggatatggccttggcaatttccaccatctgagtttctgccacactcaatgtcccaatgtttcgcttggaatcaagagaaatccccagtttctcaaaaatttcatcacatttggaagccatcttactctcatcaataaatcccatggaacagaattcatttcccataaacatgttggcagcaatgcttaaatccggaaaagcactcaattcctggtgaaccatggcaatccccaactgctttgccaccttggaatttttaatgtccacttcctttccattcagaaatatctgtcctgcagtctttgtataaaccccattcaatattttcatcagtgtcgatttaccggcaccattttcccccatcagcgtatgtacagtccctcttctcagagtgaaagagacttcattcagcacacgaatgccgttaaattctttcacgatatttttcatttccagaattatgctatgttccatgtccacaccccttctgtatactttcgtgcctcttagatttccgcaccccctgagatatgccgtggcgccagagcaattcttcccagaattgcatactgtgatgcatgacctgctgcaggaatattacctggaatacagtgaatggtggaataagccagcgtagcaaatttcactgcttctttgtactctggcagaactccaatctctgcagaagaaaccacttgaatatctcctggaatccgctcctgtatttcttttataatctggggattacggacacctccaccgcttacataaagcttcttggtggattgaatgatttcttctggtacattttccaccatactccgggcaactgcggcgcctgtaaaggcacatgcagtggcaaggagatcttccttggaaagatgagaaaatttcttcaacactcctcgaatgtaatcagcactgtaatcctgtgaccatccggaacgtggaaccggacgattccagaacggatgatgcataaagtaatccagcaatttatcatccaccttaccagatgcagcaatttcaccatttttatcatattctacgcccaataattctttacagatataattggagacaatgtttcctgggccggtgtcaaatccgaacatttttcttctatccctattagctacatgaagattggcgatgcctcctatgttcaatgtcatcgtatacccgggctcgctgcggaataatatgtaatccaaataaggcatcaaaggtgctgccgctccgccaacactgtgatccgccggtctgaaatgagtgactgtatcaatatttgtgaggttggcaatcacagaagcatctcccatctgcattccacagggataagttcccgacatccatctgccaacccaatcccttttctcctcttctgtcatcttctccatggccacatagtctgcctgttcctgatagattgtctgagtatccagtcccaataccttaatgtccttcgcatcaagattattctcctttagaaaaagtgctgccttttctgcaaacacagccccacataggtaatttagtctgtttagtcctaccatatccactttatttacaaatgcatcccgaacaatttttgccacctcttccggccactcataagatgctcctttcagaaatttgggcggcttcggaaatccatcatccccaatttctgtctctgccagaatcacgtcaataccatcaaacgacgatccactgttcatccccataattaaatccataccatttcctccttttagtttttttcatgtttatattccaatttctcctgagagaaatgagaacgttctatttttgttttaaaaatttgcagaaaggatattatatatcccttctgctatgtgatttttctacaggattctctaatcactaactgagtatccagcttcttataataggtctcttccttttccagactcccactgctgctttcttctaccctcttcaatgcctgggatactgccagtcttccgataatctcaggaaattgtacaatagctgaaatacccaatatctcattcagaggtgtatcgtcccaggtcagcagggagatgtcttcgtaaatttttttgttcaattctcgcattcccaatacaacgctgtcacataaattattattcagtaccaaaattgctgtaatatcatgattgatcaccaacaaatctctcaacattctctgtcctaaattccaatcccactcatggctgtctgcaatcagtgtatggtcatagggtattccatgcttatgtaatgcatcctgatatccctgaagtcgttggcgcacagaagggaatttgctagttgcaagaactccaattttcttgtgtcctaatccaatcagatattccgttgcctcgaaagtgccctgatagtgggtactgtcaatctgatcaaaaggaaagtttggaatactctgatcaataaatacaatgggcatggaataactctgtaactccgctgccagcttattgtcacctaaggatgacatgatgattccatccactcgtcgattctgcatcacacgaaccagctttagctcttcctgagcattttcgtgtgtactacataccataacactgtatccgcttttcattgcttcattttcaatggagctaatgactttgctgaaaaagttattatctatactactaacaattactcccagagtattagttttattgcttctcaaactttgagcaacggcatttggcttataatttaaactctcaatagcttccattactcgctttctggttttatccgaaacactgccataattgcctacaactcttcccactgtagcatgggaaactccagccagtctggcaacgtcttcgatggtggctcgctctatttctttcttcatttacattctccttgtatttgtaacttctcgtttcgttatcataattattaattgattttctattgttcattacatactcttttcgtatttaaaagagttggactacaaagcttccctaaacgccttacgccctggcaatatcaatatctccattatcattataatatttcgctcatttttgtgaacgttctcttttttcacattatatccattacaatatacggtgtcaattgtttttctgcattttttaaaatcttttggccttttccctttttttcacaatttttatctattatttttatgcagttttactcatatacattttaaatcgaataaaatattcattatctttagtcaattatgtgcatacatccgtattatttgtttttcaataataaacaagtcatcttttttaaactctacactatctaaactattttcattgtcaggtcataactccgataattcttccataactttgtgcggataaacacttcctcacgtttaaccccatatttctccatcgcctgataaactccctttcttatgcctttctcattgttataagtaagcgcagtgttaatattgtgataaccagctctaatagctgattttaccgcattgactatgatttaccgactgccacatgccgaaacccaaagccggcattttcttttcacaccattacttaaattagatgttccacttaatttcgcctcaattgcttccccccttaaaatgcatgttccctcacataagtatcagcctcctggataatcaccgaaaagttccttagtaattgtgaccctcgatgacgattatgtacttgtcaagtttccatccctctcaattccgtcgcagttcgtgggcaatatgctctttcctgtaatttgcccaatccctgctttcacttacaattgaatatgaactacaatggaatatttcttgtttcatcacataatagggtagaggaagaataaatttctcgcccctcccattgaaccgtacgtacgggtctcgtatacggctctacaacttatattccaatattatttaaaaatcgcttcgtggttaaaaccgttcccattcttttggtttaggtagtacagatttcggtagattgttttaggtcttttccattacttcatactgacataacctttcagcgctgcctgccggtcctggatttcaacctggattcggctttgcaggatatcgcagatggtccgttccgcattataaacacggacggtatgccccatgggagtctggacttctgtgatcccaatgggataccgttctttcttaacggtatacacctttacaccttgtgcagtaatgtttgttgtcctatatccttttttgaccgttaccgtatatctgagcggttcccgttctgcaagttccagcagatacagcgccgcctcatgggaaaataccgcctgctgacaccgggactgcaggatgtacataccatcctcccaggcatccggtgcaagatagatcccgtgggccattttttcatactcattttttttaatgaattctaagaaatagggttttgagattccaagatttactgcatcggatgtctttaggaccccatgattgtcttgtgacagctgttccagcatttctctctttttcattcaatcaccttactttcatactactcattataaataatagccgtatcaaagtaaaggtccagctggaataacgagcataaaaaacagccaactcacaaacggaatcagctgtatttacaatactattcttactttttactttctgctgtcaaactgttgtcagtatcatccttcccagtttttatgcaacttttttattataatcagtcacaaatacctcacttgccagctcttttgccttattgacaatgatctctaatctttccataacatcatcgctataatatttttctccacattgttcacactcttcacaaggaacattccgtactataataacgcaactaccataggttacaacatgggtggtaaaacttggtttcgttgtattgcatttacaataaaagcacatatcagttctcctttctggttttcatatcttcctggaatttattcaagcttggataatatactgttattatatacagattttcttcatcacacccaacaaccacatgtataattctattatctaaagtatacccaaataccaggcaacttggatgcggataatctgttggataatcttcgatgatttctcccctttgaagcctctgtaaccggaagaagcccaccggttacaggggttttacataatgcaaaaagcgttctcccatctcattcacttacataaatacttatgtctttcgtatcattcacacttacaacaggaaatcccgtaccagattcaaacctgttctgtttaagtatgttctgctgatcaattattgtaccgccttggatcatgtttaaatccattcttacattatccggcaatttatctaaatagacagagacccctcgaaacgcatttgcctcggaaccctccagcgtgatattgtggtccaatcgatcagcctctaagtcaaggaccacaactgatttttctgcgtgtactaacacatctgaactgattgtctcaaaataaatatgaccaaattcccctgttgtttcaactttttcaaattctttctgaggtatgtaaatgacgaaagagccgagaacattatcgtcgtcctccgaactttccattaaaatattaatatcaagtgtatggtccttcttctcataacggacttcatacttatgatctttatttaaatctgcattatcaaattcaaaatatttatttcccccttgctttacgacaatagatctggcattccccttgagattaacatggctgatgtcttcagccgcaatagtgtcatatacttttttctcttcttccttatccgtatcatccagagtatttttcccgctgttacaggcagtaaataaagatacacaaaatacacttatacataagaaacttattgcttttatctttcccatcatatctccctatggtttctgttcacattcattgtactatacacacatctgtacgtgtttctctccggcatgttaaaaacagaggaggatacactgccttttccctgcatcctccacataacttcactcactcttttgcagaaacatagttgggattctctttaaatgcctgcaccagttcctgccctggttcctctttaaacacttttttccatgatttcaacagattatcaggtgtaacgctgatcggctcaattccgataaatgacggaactttttcatttaacacagattttgcagccgccaaagcaattgcctgtccctgctcatacgggcactgtgcgctaagcaccttgatcataccgccctttgccatattcatagcatccgcataatccaggtcgctggtgacgatggcaacatcagtccgccccatttctgtcagcgcggcaatggcctccatcgcagggccgtcccaggaaatatacagagcttctatttccggatatcgtttgatcaaatcctttgtctttttataaacctcatcctctttttcaaacttgatctcttcacataaatgcagcaccggatattcctcgcttatgacctgttttgccgcattatccctttgtatggtcgcgtagaagtcagctccatggacgatcaacccatagtttttcatattatgctgatacatatattccccaaggccatgtcccatattctgtccatgagaatgttcattaatagaaacgcaggtaacataatcctccggccgcagtccatccggtacattagttattaagatcaattttatcccgctgtccgcaattttcctaaaggcatctgcggtcagtttattatcggtgggaatagcgatcagaatatccggttccagcatcctcaaactgtccagttgtctgcactgcaattgaggatcaaagtgggcgtctgtgatcgcaatgatagagatacccagattgtcaaaaatatctcgtattcccttttgatgcagctccatccatgcttttcccgcataatggaaggagatagctgccgtcagctttttattcctgatattctgtgtttcagcttccgagagtacaagttcactcatggaagacgccttttctccaaacgggcctctgccaataccgcaggttgaggagcgcaccaccagctttgtctgcagcataacggtccgatagacatttttgtaggcgggcacattggcatattctttgtttgcaatcctttgcagcaaggtctcaactgtcagttttacatactgttccgtatcctgttccactgttgtaagggccggtgtatgcaggggcgcccagtcaaaggaaccgaagcataccacggatatgtctgtgggacaggtgatattgtgggcatctatatatttaagaaaaggtattaccaccgcgtaattggcaacgatcagggctgtgggcatttgttcaccgctcaaaagctcatccaaagcctcgaaaatatcctgctccttttgtaaatggggatagatatattcggacagttccggtatatgatactcccgcagcgcttttttgaagccttccagccgtttcggcgaacgctccctgcttctccccagaaatccgatccgttcatggcccttgttgatcaaatgctttgtggctttataggctccatccaaggtgtctgtacaaattgtgtctgccataaaattcctgacttctctgcccagaactataacagggaccttgacatccaaaaggacacgctgtataagaatatccttttcatccggaaagacaataatcccggttaccatattcccagccagcaaaacatcaaaaaagcttttcatgccggaaatatccgaattacattctatggtgatcaaagaataccccgtatctcttaacccttcatcaatctgctgctctactctgcgctgaaagctgcttttcttatcagcgatcagcataaggatatatttctcttttatttccggcatgtgcggcaacgttttctttagaacaaaattaggcggagtatccagttcccgtattgctttctccaccttttcaactttctcaggactgacataacgtgttttgttgactacatgggaaaccgtagatgttgaaacacctgccatttttgcaatgtcattaattgtggccatattatcattctcccacctgtttatagtatacggctgctatccgaaaaaacacctcacgggacagcagccgtgtgtagttacagtatattactactatacagttacccaaaagaaaagtcaatttgttgcgcaaattcgggaatattttcgtaaaaaaagaaacaggaaccgcaaacggttcctgctctgtctttttaatcttcaactttcatccatgctttattctgcgctgatctcataacagcatcgcagactctctccacgcggtatcccacctcaaaattggtactgggctgatacccctctgtgaccgcctttataaactcgtacatctctatggttttcagttcgccgtaaccgatattcataccggggatattccaggttacttctccgtggaaatgcgccggtcccgtataaattgtcttgaatcctcttctgtcatccggatcatccgcaaagcatacctgcaattcgttcagtctttcataattgaatgcaatgctgccctttgttccgtgcagctccatggtgataaagttatttctgccccacgcattacgggttgcttcaatgctgccgacagctccgtttttaaactttaccaggaaggaatcttcatcatccacgtccacttcttttctgggggcatctgcgcccagctttacagtgccaagcaggtccactccgccttcctgtacaggcctttctttgatatatgtttttaccatggagactacttcctcaatgtcaccggccagatactgggcaatgtcaataacatgtgatgcaatatctcccagagttcctgcccctgcaatatccttctggaatctccatgacaagggggaatccgggtctgcggaccagctctgcagatatgtacaacgaatattcagaatttccccaactgctccttcgtcaataaattttttagcgagatcgatcgcaggaactctgcgatactgatacgcattcatacttacaatgccgttcttcgctgcttctttggcggcatccgccattgcctttgcatcatccaggttagatgcgatgggtttttcacaaataacgtgtttgcctgcctgcagcgcagcgatagcgatgggtgcatggacgttgtttggtgtacaaatgcttacaacatcaatttcaggatcattgataatatcatgccaatctgtgcagctcgcctggaatccaaacctgtcctttgcttcttccgcgatagacggctcaatatcacagactgtttttaatacaggtactgccggggcgggccagaaaaatttcggcatattagaatacgccaccacatgtgcctttcccataaaacctgctcctactaatcctacatttaattttttcatgatcgaatcctccttaaaatattttttaattgttcttttttcttcggctgagattgctgatggcaaccgccaggattataattccgcctttgatcattgtctgctgcgcagaactaagatttgcaaggatgaccgcgttattcatcatccccataagcacggagccaaacagcgctccgatcacggaaccggtgccgcccgacattgcagttcctcccaatacgaccgcagcgataacagacatttcatcgccgtcgccgtaggaatatcttcccgcctgcatacgtgccgcatacatgatccccgcaaacgccgcaaatgcgcctgacatagtaaaagcaatgatcttcactctgtctgttttaataccgctgtagaccgcagagttctcatttccgcctgtggcgagaacatgtctgccaaatgcgcttttgttaaagatcagaattcctataatataaaacaggatagtccacaaaaccagcaccggaatccccgcaacgctcccgatcccgaaaatattgcaaaaagttttatttccaatgggaaccgcggcggtattggtgatccacatggcagcacctcttacgatctccatgataccaagggtggccagaaaagccggaagcttcagctttgtaaccagcagcccatttatacagccaatgaccacgccaaatcccaagcccgtcaccagtgccagcagaatactgtttgtagcctgcaggacaagagaaaccagcattgccgtcatggcggttactgcgcccaccgtcaagtcgatctgccccgctgccatgacaaaaacgccggcaaccgccataacggatatcattgctgtctgcctcagaatattgatcaggttcctgggctgcaaaaagcctttattccccaggatcaatgcaaacagtatgaacacagcggtgaaaataatataaaccatatacttatcccactgtatattctttttatttttgctggattgcatattgtaattcctcctctgaatctattttgctcctatccatctctccggtgatccttccatcatatatggtgatgatcctgtcacatactgccataagctccgccagttccgatgagacaaacaaaacaccctttccttcctccgcataatccctcatcagcgcgatgatctctgctttcgcacctacatcaacgcctgcagtgggttcatccagcatcatgacttccggctgcatattcatccacttggcaaggactaccttttgctggttgcctccggacagcagattgatcctcttatgaatatcatctgtcactatattgagcttccggacattatcttccaccatctcatcagccattttttcgtcaacaaatactccgtgttttctcagccttgccaccttcggcaaaatggcgttttcttttacagagtggatcagaacaagcccctttttccttctgtcctctggaatcagtgcaaaaccgttcttaacagcctctgtggggtttcctatcttcatcgttttgccgttcagctttacgactcccccttcctgtttcctgatcccaaacaaagtctccaaaatctctgtccttccgcttcccatcaaaccggcaaatcccagaatctctccttttttcaaactgaaagaaatgtctgatatcctgtcgtttattttgagatgctctacactcagcagatcagggccgtccttatcatatgttctgggaatccagtcaaattttttccctgtattctcccccatcatatgagcaatgatctcatccatagtgatgtctgagatccggctggtatgtacaattttaccgtcccgcaatattgatatactgtccgcgatctccatgatctcactcatacggtgggaaatgtagatcatggaaacccctttattttgcaggtccttcatcatcttaaaaagctgtgtggtctctgcatctgataaggacgctgtaggctcatccagcaccaggatcttggcctctttttccatagcctttgcaatctcgaccatctggcttaaacccacgctcagattaccaaccatctcctttgggttcacttcgatccccaattcttccagaacctcacaggagcgtcttgtcatatctgaagttttacggattcccttttcaacgatctccgctcccagaaagatgttctcctccactgtcatactctgaatgagagataattcctgaaatatcattccgattccgttctttttcgcatcgtgggtgtcctgtatggatacttcctgtccattgaccaaaatcttcccggcatccttggtgtaaacacctgtcataattttcatcagtgtagattttccggctccattcccgccaaccagagcatgaacttcccccttcttcaaggaaaaatcaacgcctttgagcaccggtactccaaaagatttttcaatcccctgcatttgcagcacatatgggttcattttctccctccttatctgcctgctgcttcctgcagccagtccggcgcctcaacatggtagacatctttatacgcttccaggatattggatccgtctactttttttgccgcaaccgcaacatatgccggcgcctcttttcccagcagagaatatgccgccagtgtcgcctccgcaacaccctggtcatacggaagctgtgcacccagtcccacaacattgccttctgcaatttctttggcgatattattccccaagtcaatggtcgtaagcttcacatcatctccggtcaatcccgctgcctttacagaggagagtaccccctccatgggaacatcccagctcgcatagataccattgatcatagggtactgtgttaaaatggcatctccctgctcggaacatccattttcatctgtaaatccctgttctgtcacgatctcaatatccggatattttgctgccattgtctctttaaaaccctggtctctctggtttgtcacaaaaaagtccgcatcataatagaccattccgatctgtccttttccgccaagagcttcgcccattaattcagcggcaacgcagccgtttccatagttatctgcagatacacagctcacataatcttttcccgctgtcatctctgacggaacattgtccataaataccagcttgatcccttcatctgccgctttcttgaacgcgtcggcagtagctgtggcgtctgtcggaatactgatgatgacatccggatcttttgccatgatagtttctatgtctgatacctgctgctctgccgaaaaatttgcgtccgtggtggcaacaatttctatccccaggtctttaaatgtagcctttaaaccttccaactgggaggttgcccagtcatttcccccataatgaagtgagatcgccgctttgtatccgccatcgcggatctgctgcttctcttcctctgtcaacgtaatgtcagatgccggcgcagccgcttctccgttcggacctgttgacaagattttactaccgtctccggcctgaacagccttatccccgacatctgtctctttttctgtatctgcatccgctgttgtaccgttctgggtctttgctgccgtatctgaactatctgcagaatttccggaatttccgcagcctgccatcattgtcccgatcattcctatagccaataccacacttaccaattttcttttcatactctacctgccctttctttttttaaacaagtttacctttaagatactcataagaagtcctgcacgcggaaaccggatcaccggcatatccatctacttccacaagataatccccgctgtaatttttctgtttcaggaaatcaagaaccccgtcaatatcaatacttccggtaccaagaggagcaaacccatttttatccagatcttttaaatgtacaaaggagatcctgtcataatatttctttacgatttccaggggatctcctccgcccgctgcaaggtgcgctaaatcaggacagatatcaatagatgttctggcaaacaatttatcaatctgttccggcgcctctgccatggagccgagatggggatgatagcttgctttcagtccgtattccccaaacacctgagcagccatatccagcccttttcccagcagtgtgtaatcttcctcccgaatcccttttcctctgatcgctcctccgcagatgcctatatatgtaacgcctacttcctttgccgccttggcaaccgtttccatatggtacatttcatcttccagagcatcctgatatataaagtttgctcccacacagacgctcatcatttctgccgaatacctttgcagcatatctttcagcaccgaaaggtcatcacaatattttgtaaggttgccttccaggacttcaatgcttctgaagcctacctctgttatgcttttcagaatctcctcatcattacccatagtcagataccggatatctttaacacttgtcacaccggcgccatcccctacaaggggaccgaaaccatttgtcatataaccaactctcatgtactatacctccatttttgtgctttttattaaatttgcgcaaattttcttgatgcagcaatcatacctcgtttggttttattcgtcaatatcttttttaaatccttctatattttggcatatttccacaatcatgtacacttcttattgtcacttttcacacattgactttttctcccctccccctcataataggttatataaaaatttgcgcaaatcatttttgctattgttacatacttcttgcagcgcacaagcgctgtgtcattcttgcagaaaggaatctatttatgaaacttggatttatcagttcaatacttgaatcctcttcctttgaagaggtcattgacaccgcctcagaacttggttatgagtgtgttgaagcagcctgttggccaaaagaaaaagcagccagacgttatgcgggaatcacacatattgatattgaagcacttaccgaaagcaggattgcttctattaaacaatactgccttttaaaaaatgttgccatatccgcactggcctattatcccaacaccatttccgatgatcttacccagcgccaaaaggcagtggagcatttaaaggctatgatcatcgctgctccaaaattaaatgtcagtaccatcactacctttatcggccgtgtccagaatctgaccatagaggagaatctgaccatctttaaagaggtgtggacacctattatcagacttgcagaacagtataacgtaaaaatagctatcgagaactgccccatgcttttcggccccgagcagtggccaggcggacagaaccttatgaccacccctgcgatctggcgtaaggcctttgatctgatcccaagtgatcatttcggtttaaactatgacccctcccactttgtctggcagcagatggattacatcaagcccttatacgagttcaaagaaaaaatcttccatgtacactataaagacataaaggtttaccgggataaactggaggatgtgggaactatggcttaccccttagactatatgtcaccaaaactcccgggactcggggacgtaaactggggaaaatatgtatccgcattgaccgatatcggctacaacggttatagctgtattgaaatagaagataaagcctttgagagctcttccgaacggatactggatgctctccggctttccaaccgctatatgagacaatttgttatttgaaaggagaaagtatatctatgaaaccagagaaaataaatataggacttatcggagccggttttatggccaaggcacactctatcgcatacgccggtatgcccatgtttttttggccggctcccgcaatccccgtaaaaaaaatgatcgtagatatgaatgagtccgttgccagagatgccaaagaaaaattggctttcgaggcttattccacagattggcatgatatcataaatgatccggaaatttctgttgtagatatctgcacacctaataatgtacacgctgaaattgcgattgccgcagcaaaagcaggaaaacacattatctgtgaaaagcctcttgcattgacctccgatgaggcaaaagaaatgtatctaaccgcaaaaaagaaccatgtaaaaaccatggtggcatttaactaccggaaaacacccgcggtacagcttgccaaaaaatatattgacgaaggtgccatcggcgaaatccttgactttcgcggtacctatcttcaggactggtctgccgatcctgattctcctctgtcctggcgctttcaaaaagatatatgcggaagcggcgccctgggcgatatcggaacccacgtggtagacatgctccgctttcttgtaggagattttaaaagggtcaacgcccggacagcaacttacatcaaagaaagaccgctgcagaccggtatgtctgacagcctgggcaacgcgcgtgtggaacagaatactcctaaaaaagcggtggacgtggatgatcagtgcatatttatggtggaatgcacaaacggcgcttttggaagcatcgaagctaccagaaacgcctggggaagaaataactatatcacttttgagatccacgggacagaggggtccattttctttaactacgaacgccgtgatgagcttcaggtctgctttgccggcgatgctgcagacagacggggattccgcacggtatacacaggtccaaaccatccttatggaagcggattgtggcccatccccgccctgggcatcgggtacactgaaacaaagatcattgaatgttatgatttcttccgctctttacaggaggatacagaacccgttcccaatttccgtgacgggtatgctgttgaattgatctctgatgccattttaaaatcggcccagacacatgaatggactgatgtaaaagatttatgtgcggacagtgatccgtgttaaaaggataaatatatgcccctgcattgacgtttaccataaaaacgtcaatgcaggggcattcacctcttttttgtggcataaacttcttttttttcactcagaaattctgttacacacggtaaaccgaattttgcctgtgtcttaattgtatccttaaaataactgaggttacataggtggatttttatatctgttggttatttttgtgttttagggttgtggtacgccaactatacagcactaagtcccaacagcaaaattgattatttcttgtctttttcccaaacagatgataaaatcatacaataaatcttaccgtaacatcgggataattccgcaaactaatagaaagaagtatattcatggaaaatacacaaaaacccaaagtagaattcagatattatgccaccctgcctcagctccccatatattttctgaccggggacaactggctgaactgcatcgggacacggactgcatgccttcatttccacaatttaatggaaatcggctactgttataatggaaatggaaatttacttctgggtgatcagggtctcaagatccagccccatatgatttccattattccccccaattatccccattccacagacagtattcccggcagtgtcatcacctgggaatatctctttatcgatattgacaaatgcctggaagctgcttacggaaatgacgaagccaagctgaattatatgaaaaagctcatcactcagaaggcgcattttatccgtgcaaaagaatatcctgaaattgccggagaatttcgcatcattctccatgaaatgctgatgcagaaggaatacaatatatatatcgtaaaagccatggcattttccctgctcatgaggatcgcccgcctgactttttcggaaaccgacgatgagtttttatcctgcagtaaacccctggatatggataatataagccagatcaaaccggccctcgatcacatccgcagtcattaccgttcccctatcaagattcaggatctggccgatgcctgcagtatcagtgagacgtatttcagaaagatattcaagtcattcatgaatacctctgcccttgattatatcaataagatccgaatcctgaatgccgctgactccatgcgcagcacagactgctccatccatgagatcatttccaaatccggctttacctctgaatccacgtttaacagaaacttcaagaaatatatgggaacttcccccaaacagtggcgggaaaagtatgcgggacaaaaacggcagttaaaagattttgatatatatcttgaaaatggatggtaaacagctgatatcctgctttgtagttgataccggggtatttttcagaatatttatttttcattacataatagtcaatcttttataagtgtgatacaataaaaacatcaacaattattgtgccatgcaaaggaggattgcatatgtgtaccactaagcagtatcaggcaagaacgaaacgtatcgacgatgcccttgcggtcaaagaacctgaccgtgtacctgtaattccttttgtccagacctactctgtcacccattctggacacaccatggcggaggccatgtacgattcctcaattatgcagaacgccctccgtcagtatctgaatgattatgaaccggatgcaaactatggctattccccgtttttctgcggacttggaccgtgttttgaactgacgggaatctctttcctgcagtgggccggacaaaaaggcggtgtctgtactgagaattccatccatcaatttgtggaaaaggcgtacttaggtgatgaggagtattcagaactgctgacagatctgaccggctggatcatgaagagataccttcccagaaatttcaagctgatggagcctatggcaaagatgtccttcggccaaatgctgggatacggcgctcttcccggaatgatgcagtttgcagatccggccattgcggaaatgttcgtgaaactgggggaggcagccggaatgatctcccgttattaccaagaggcccataactttgacgtggaaatgatggaagccggatatcccttatttttcaaggccacaacaacctgcgccttcgatatgctcagtgactgtctaaggggcacactggataccatggctgatctgtacgaacagccggaaaatgtccataaagccattgactttttctatcccggcacactctacggggcacttgcccaggccgaaagctccaaggggaaggttgtatttattcctctgcacaaaggccttgacggtttcatgggaaatgaacagtaccgtgaattctactggccgactttaaaagcactggtagaaggtctggccgctgccggacagatcccctacgtctatacagagggaaaatatgattcccggcttgaatttttatccgaacttcctgccggaaagtgtctggtccactttgaaaactgcgacatgagggaggccaaacggatcgtgggtaaaaactgctgtatcagcggcgggtttgacggaaggatactggagacagggacaccggagcaggtgacagacgcggtgagacgccttttggacatctgtgctttggacggcggttatatttttgatgtgaataccaccattgatcatggggtaaagcatgagaatgtacttgccatgttcgacgcggtaaagacttatggaaaatattaatctgatacaaagacggcggctgtaaaattcacaaattcttttacagccgccaatttatttagatcctttcagacagatgcacccaggtgtcttttgtgagaaagctctcccccacctgctcctccatctccagatatctgtcatagggaatactgaaggacaacagttctttgctgatgcatttccgcgctgacgggtcggtaagtcctatggtacattttcttttcccatcctcctggtcactcactgcatagagaatggcctgtgcacaccctgcgccaaacttgatctgtacattatcctgggttggctggtcatagttggcaagtgtggcaagcgcagaaagctggtccgcatttaccaaaaaaacaaccgcctccggcttctcctcctcttttacttcactgagcggtttcagtacaacgtatctctcagccttaacctttggtacattctctgcgtatttcctagccagatcagggttctttttataaaattcccccggtttcgggcccacgcctcctgtagatagaaaatattcgatggtccccagttcaaagcctttgaatcccatacccactttgcctcccggacatgtggtggtttcctcacaaaacgccgcggttctgccctttgacgctgcggacagcatagggatcacacagccccacactccctctttgaaatgtatggctccttcaggcatcctgtccgatttgatgactgccacgggctgacttgacagcttaattgcctctttcattttacttttcatagaatcgtacctccctttctgccgggtaagattttacatgactggtctttatgctcacattatacctttttttttgctgtctgtgtaagactgtctatatacatatttttatcaggaactgacactgtcatatcttttcaaacctgttttccatatcacaaaagtcaacaatgtaaaaaaagccagtgctgccccttcctgcaatgccattttccatgtaaaatctcccagcaggatcaaagatggatatgtggaaattatgccgtaaggcaggacataataaaaaacaaacttatagactccataaaacaccgtaccaggtatctgcatacacagatccaggccatttatctctatctgcagaatgccctctgaagataccgtaaaaaatgccagtgaacggatcattacctccagctcataaaacaaaattgtcatcattcccacagaaatcacataacccaatgtattactgatgttaaagtctatttttgctgcatttgcgccgtaaaaaatgatagcaatactgaagatcacaagaggcacggcccctggatttacctgctcaaaggtcagcctgagcagagggctgaccggttttgtcaggtacagatcgatctctcctgtcctgattttttccggtatggaattaactccgaaaaagtaaatactcatattgagagcattgataagagaaaatgttccgataaaaagtatcatatctccctgcttccaattgccaatcctatccacattggaataaatggcctgaaacaccagaagctgaatcacaaataaactcccatctacaaaaaacggcccgaaaaaaccaaggcggaacatcatcactctctctaaccttaattttatcagcactttgatcaatcttatattctctctcatttctgtccccctatatcccggctccgtcatatttcactctgtacttctcataaacaatcttttccagaagcctgatgcccagattccagcccagcataataaatactcctctcacagcttcctcaccgtttttccccatgagcagcatggacggcagatatgcagtatagtaaaaaggaagggcctgcatacatttcaccaccatctcaggcaggagaacaagaggtatgacagaacctgagactaaagccaggatattctgctttatcatcagaaatgtagatatctcttcaaaccgaaatgtcaggattcccagaaaataactgagctgtgccataaaaagcagccccagaaaagcaatcaccagggcacacaaaatacaggtgatatctgaggtaatacttatcctgattcccaatcccaaaccgatgagaaataccgccgctgcatccagcacaatatgaggcaatatggaaccggcctccatagccagaaaatagttgtcagcatccaaaggtactgtcatatatttcgagaaggtcccgctccttatccctaatgtgatatccccacttattttttccgaaatatcaatctgtgcaaaaaaggcactgagcagatagtatgtcatcatgctattcttggtaaatcctgctaccaactccctatccctgaatatgatgccccacagcaaggaagcaaatatgattttcattacaatggatataaaaccaaatatcaaatctgccctccacataagttttactttcagatacacttttgccgcttccagatattttttcatgtcctctccctcacatctgcatagatcctttccaccactctgccaatctcttcctcatccagagaaatgtccgtgggcttataactcataaagtattccaggaatctgccagagtcctccttaggcatttcatatacttttttataaccattgtcctccagaatcctgcatttctctgccagagtttccggaatctcaatcttagtgagtttctcaaataccagtgttatccttttactattctgatagcgctcaaagagctgttctgtgctgccatcatataccttcattccctggctgataacaacagaccgcctgcaaagggatttaatatcctccatatagtgggaagtcagaagaattgtcgtcttcctgtcctgattcacttctttcagataccttcgtatctgcatacttgccactgcatccaaacctatggttggctcatccagaaaaagtattttaggattgtggagcagagcggccaacagttccattttcattctttcgcctagagacagggtcctcacctgtacatccataaggttcttgattccgaacagttctataaaatagtccctgttcctctcgtattccttttccggcagatggtacatttccttaaaaagctggagggtatcccctgctgtcagctcgaaaaacaactggctcttctgtcccattactaaagcatactgctgccgaaactgtttctccaatttatttggataatatccaaggacactaacagaaccgctggaaggtgctataatacctgtgagcatttttaccagggttgtctttcctgcaccattttttcctatcagccctacaaattccccttcttccacacatagatcaatatggctgactgctgttttctcttcatattcccgccggaacaggcctgtcagactgccctttaatccctcacgctttttataccttttgtaaacttttgataagtctttaacttctataacgttcatattcatctgcctctttcaatttctatacttaattttacgcacaaaaaaactcatggtatcttgcttacattatgtcgtaaacaataccatgagtaagtatgtaaattatatttcttccgatctatggctctatggccttttttatagcctcctaagaacttaacaagccacttaagcgcctcaagatgccagagtacgtttaaatatgaacctttacagcgcgcgcaaacaatctacagtatatattctccttacggcagtgccgcagctaatgaaaaatatatctgctgagcttggcatccaaggctgctgaaattaacgatccaatacgtaccggaacccccgggaaatatatgaaaagaactttacttttggtgtgcttcgtttcctgtaagcaaaataaacctgtacaacaataaaagagttatctgtaaccacaactcttctttgtattagattatacatttgatttattttcttactacaatagacaaacacacacctcccgttttcttctgtttttcattataacctgccatatctttacctgtcaatcactatgtcatttttcagtcaccctcttataaccgttcatcactgtttacagcacctgaaccttttcctttcaccgaagacagattcctatactcccggggtgtcattttcacgatcttcttaaaaatagtgttaaaaaacttcttatcctcatatcctaccgcctgagctatttctccaatcctcatatcactcccggccagcaattgacagctcttctctatccttaccttctgcagatattcccggaaggaaagccctgtttcctgccggaagatccggctgatataagacaacgtataatgatactgctgacagaacattcccaagtttacataattctgataattgcagtcaacatactggagcacgtcaagcaccgcccggtgctttggatgctttggtttctcatgaacgccttttcttagagtcaggatcagcagttcgatcagcctgcaacgaaagacctccgcatatccctctttcttctcctcatattcctccagcattcccatgatcagttgcctgatccgtccatcctcatcgtgaaaaatacgattccccggtgtctcccccggtatggacgtgtagtatcgtatcagacagccatgaagaagttcatctagagaacggcagcccgtcatggtctcatctatgacttcgggcaaaaagatacagttgatcagtgtaaaatcctcactttttgaatagctgtgcacactgccatagtctatgataaagtaatccccttctttcagaactccctcccgggagttcagtgtatgcacagctctcccctttactacataaaccaattcaaagaaatcatggttgtggctttccatatcggtctgccggtacggcatcattaccagcctctcccggctttcttttgatacttctctgatatggatggttactgccttatccataaacgcaaattcaccccctattttagtaaaatacaggtgtttctttcaattttattctctggtatcatgaaagtcaagaaaagaaaaacggaggtatttcttatatggaatggcatgcaaaatggataagaccacagacggatacaggcgatatctgccccctgttccaaaaagatttctatctagaaaaaccggtaaagtctgcaagactttttataacagcccttggcacatacgaagccgtgctcaacaaaacccgcgtgggggaatttattctggccccgggctggacttcttatcaaaaacggctccaatatcaggtctatgacattacaaatcttctgaaaaaagaaaaccatatttccgtcactgtgggtaaaggctggtaccgcagccccatgcccggctggagtaaatccgatgtccaggaggcactgaaaaaaagtcccgcagggcttctcgcacagttggagatcatctgcgaggatgattccgctgtgtataccgcaacagatgagtcctggactttttcggagagtcccatcctcttttcggagatatacgacggagaaatctatgacgcttcactggaatgcgaaagcacatctataaccggagatgaacaggcacaaaactctgccgggcctgtatgtgaatttgaaggtccgacacacaccttaatcccccagcagggcgaagagatccgggagcaggaaagacttgcgcctatacgtatctttaccacaccaaaaggagagactgtggcagacttcggccagaatgtcacaggttatgtggaaatccatctcacagccagagccggagaaaaggtggagctttcccatgcggaagttctggacaaagagggatgtttttatacagaaaattacaggactgcaaaagcccaatacctgtatatctgccgtgacggtcagcagtcctacaagcccaaactcactttctttggtttccgctatatacggatcgaccgttttcccggaggcccggctgccgcaaaaccagaaaatttcacagcagttgtgatacaccctgccatgcagcggaccggatattttaactgctctaatcccctgctgaaccagctctttgacaatgttatctggggacagaagggaaactttgtggacgtacccacagactgtccccaaagggatgaacgtcttggatggacaggggacgcccaggtattcatccgcacagcctgcatgaattatgacacggaaaaattctatacaaaatggcttgcggatatggccgcagaccaaggggaagacggaagagtcggccatgtgatccctgacctgctttcccaggagcctgccagttctgcctggggcgatgcggctgccatctgcccgtgggaactctatctggcctatggaaacaaggagctgttatcctcccagttcaacctcatgaagaagtggatctcctatatttccacccataccacaacagaatatctgtggaccggagggactcattatggggactggcttggcctggatgctccatccggaagctataaagggtccacacgggaggactttatcgcttctgccttctattcctattccacttcactggtgatcaaagcgggtaaagtattgggtgaaaatgtaacagcctatgaagacctgtataccaggatcgtgactgctttccgcatcgcttatcctgaatacaggacacagacagagtgcatcctggctgcccatttccagcttgccccggactgccaggccgcggctgaccagcttgcagctatggtaaaacaatgcggcgtacagctccaaaccggttttgtgggcactccatatattctgcatacgctgagcgatcacggatatgcagagctggcatacagtcttctgctcagggaagaatatccatcatggctgtatccggtcacaaaaggcgcaaccactatctgggagcactgggacggcattatgcctgacggaaacttctggagcgcagatatgaattcttacaatcattatgcttacggctctgtggctgactggatctacagtgtggctgccggaatccagaggattccagaattcccgggatatgagaaggtgaggatcgcaccgattccggacagcagacttggatggctgtccatatccctggacacacgttatggaaccatacgctcaggatggaaaaaatcggagaatgtgtggcgttatgagatcagcacaccggtggatgcccttgtggtgatcgcagggaaggaatgttgggtaggaaaaggaagttatgtattctacagtgaaataactaatattttccaatgaaatcatacccactataactatgtgttgagcagaagcaggccgcccagacacagcaggattccacagatttgttttaagcttatcagttctttgtaaaagaccacacccaccacgatcagaataaccgcaagaccgatattagcgaccagagaaccgacgctgaccttccagccggctctgtaaatggcgatataaccaaattccagagcaacgacagatgctcctaatacaacagaagcccagttcaattttcttaactctgcaaaataacctctctcggcagacgttagataaaacattcctatggacaaaagagtacctaccagatatgtcacagaaagggatacaaaggcatttgcctctgccggcgttgatttggcacagatgttataaaccgtgttggagccaatcactaaaaggataggccagatatagttccacatacttttctcctccattaataattctcggacacacgctgtatcggacagaaaatccagaaaacttcccatacaacaaaaaaaagccgcaaaccaatgaccttcggtttgcggtaggtgtccacccaatctctattttatgtcagattttcatgtccgtcaaatattttctcttatttttatttttcctatttatatttatatagactcctgttaccgatcacagatccaccagtaactccccactccacatatacagaaattgctgccgcactgtgacatccatccctgtacagcagcaccttcattcatccattcattgatttcttctgtttgcgtcattactctctttccgtatatgtgcagatcaaatccgctgctttttccgctgcttacaaactggcggctgacgatccgcttccatacatcatcggatgccgaatacccggcttttgcttaccgacccgaaaattctcatcttggcctttgccgcctccgccgctgcctccacctgataggggatgatatctgtcatacaggtttttccctctttcagcgcctgctccgcagcttttgccgctgctgtattaatatctgtgaagatattcaccttgctgatgccgcaggcgatggactttttaaagtcttcctccgacagcccggaacctccgtggagcaccagaggcacatccaccatacccgcgattgtcctgatcctttcaaaatccagtttgggtttgaatttgtaagcgccgtgagcagttcccactgcaatggcaagggcatccgcatgtgttttttctataaactcctttgcctggaccgggtctgtatagtatgcttccggcgtttcccttcctttctctcctgctgcctccccgttatcccccacatgccccagttcagcctccacagttgcgccgaaacagtgggcaatccttgtgagttctcggacctttctcacattttcctcatagctgtctgtggaacagtcatacataacagaggtaaatccaagcttcaacgcctccatgcatttctcaaaggtaagtccgtggtcatagtgtaccaccacagggacagatgccctgtctgccatggagacgatcagaggtgccagatcatccagcggcccgtagggaagcagaatctccgctgtaccgatgataaccggggagctgagttcctccgctgcctgcagcacccctcttgccagttccagattcacagtattgaacaatcccaccccgtagcccttctgcctggccgggagtaatacgtcatttaaatttgctaacattttacaaactccttatctcttaaaatcctgtttttcccatccgctctcaatcatagaagccagttccttaaggggacggatcccgcccagcgcgtcataagcctccacacatgacgccccttctgcagccgccagacggatacacatttcaaagggatacccctccagcattgccgtcagaaatgccgcgatggtcgtatcacctgcacctgtacccgacagcacttttttaggccgatagcttgcctcaaatccatctctgtctgaccagtcctccgcagagattccaagggatgcctccaattccctcaggcggctggcttgcgtggtcctgtaatacaggccgggggcaccgcatttcagcagaaggacctttgtccccaaatccatacatttatccgccagaggcctgatatctctctgaacatccaggaaaaaggaaagatcctcaccctctgtcctggtcctccactcctcatatctctccctgtccagcatgaagcagagttcctcgatactgggcacaaaaaaatccacatacggcagcacccggcttaaaatctccttccagtccgcctttcccgcctctgactccccgtccacaaaagccagatccagagaggtggcagtcccctgggatttcagatatctcattatccgaaccagttcacttcctatattttcaaacattttcttcatcagcggcggatagccgaagtgaaacaggtctgtccccaagagcttttccttcggcagatcttcaaaggaaaatgtatgattgcatcccggatcatgaagaaatatcctgtctactccagggagcgcaaggacaacagaataggaggtattctgtccttcctgcacaatgatcccggagtctgctccctgtgcggcatagatatcggaaatgatctttccgaattcatccctgcctgtctttgccatgagacatacatccatccccagcattttcatcgccatacccgtgttggataccgcaccgcctgcgtggatgtcaacaccctccatttggatcagctttcccggcgagagaatatctcctaatttcgccggcggctggttctgaggaaaaagaggggtaatgtccagacaggcatgtcctgctacgatcacctttttgcccatttgatcacccttttctgtactgtcacgttttttactcccgctgtagaacgggaaatccgtaccttttacacttaaattcattttataaactatcttcagtttaatcgtttttcttctgcggagcatttccatatttgtgaaaatacggcgattatcttgcgcttacttatttctttgatgtaggtcttgttttataaggatcatcggtgctcataggtgttatagattcgttttatttgctatttacaaacgattattttgctatttttttgatttttttgaattgttattgcccgtctttggaaatgacattagaatagaaaataagaaatcatgagaaagcagtgacggaaatggataaagaatttgaattgatcgcacacccccagatccacgccttcagcgccatactggtacgccttttttcccgggctccacacgcccacagggagatggaaatagggcttgttcttgacggaaatgtggaatttacagtaaacggaaatacgcacatacttcacagcggtgacctgtatctgctgaaccccatggatctccatgaaatacggggactggatggcagcgccctgatcctggccattcagatgtcccggcagcttgtcacctcctattttcaacatgatgaaaatacatgttttctggagaactgcgtacgtccttttttctcccagcatgagacacgctacgaagtcatgaagggtctgctcattgaactggcatacaactacttcgggcagtttgccaattatgaatataaatgtatgagcctgctgaatatgatcctgtacggccttcacacctatgttcccaagaagatatataccgattctgagatgactgcccgcagacaccggcaggagcgcatgagccgcatcacagactacatagaaaaaaatttccgacagaagctgctgctgaaggacattgcagaccatgagaatctttccctgacctatctgtcacatctatttcgggatgagttaaacctgtcctttcaggaatatctgaatctgaaacgttttgagtatgcctgccgtcttctccagaatacggataaaaaagtgctcaccgtaagtattgagagcggtttttctgatgtcagatacctgaatcagctctgtcagaaatattacaactgtccggcctccgaactgcgccaaaaaaggaaggagcctgcccgttcggacaggcaggcggcctctaatacccagaatatatttacagccggggacagtatcctgcttctgcatacactgcgggaaaaatgtcaggaaaaatacagtgattatactatatgggaattttatggctaaagaggcggcagatgtctgccggacgcagtctgcgcggcaaacacatccgtcccgcctcaccgcagcgcatcagtcaaaaatgatcagcgccataaacaccagatccacatccccggtatttaccagtccatgcccgtgaccatccggtgtaaatgtgacatcccctgctttgaccgggcgtacctgcccgttatcatcgtaatcgccctggccggacagaatataataggtctcgctctcactgtgatgctcatgatatcccagggaacatcccggttcaatgatcacttccgcgtacagtccgcattttccattcagttctttctctcctaaaatgtgcttaatgatcacatggcctttgccgccgcacatattttccactgtctctgtttttatcataattcatcctccatgcaaaaaggtccccaaaggtgggttttcgcctttgagaaccttttttctaaaatttattttttctatatcttagacccatttttttcaaatgtcaatcttttactgcgtactcttttaaaaacatgcctgatctaacccttaacatgaaacccattctcctctatcactggaacgtcttttgcctctaccccttcgatccttataaaatttcccatggacagacggtccagaaagctggctatttcttcctctctgccctgcagttccagttccacacagccgtcccaggtatttttcacccagccggtcaactgcaataacctcgccagatgctgggctctgtatctcagccctaccccttgtaccatcccggtcagtatgaaatgttttctgatcttcatcttttatgccccgcttctccctatatcaatctacattttaagttcagcatacaaaagccaaatggctgcatctgtaaagctgctgaacaatctcattataccatgttttatcatgtctgcaaccattctttttttctatatatttttcttaaaaaaaccgccctgcggccagtttgttttcttggccgcaggacgattttaagagggtgtcctatctgtatttcagtgttgttccgattcccatttccaaagctttttcatatactaactgtcccagtgcaatgtcatttgtggaaagaccccggtgccagaaaagtatggtctcatcctctctttctcttcccggtttcctgcctgcaacgatctcccccagctccccgtagagggtatccgcgctgagtttccccgtctccacgtgcctgcgaagactgccgagaataccgcctttgcactgtccccagtcatccaccacgatcttgtccatcacgtctgtgagagacagctccacagcactgacagttccgtaaggtaccacaaaatttcccggctgtacccactctgttttcagcagaggtgtgggctccatcaggcgtgtggcctccaccataatatcagcccccttcagacactcttcactatttttagtcaccttcaccggtttccccagcttctttgtgaggcgtccggcaaaatcttccatggattctcttcttctgctgttcacacgaatctcatcaaaatcatataaggagtccagaagcaccacattccaccaggctgttcccctggatcccagatgtcctaaaattttattttctttctttgccagatactttgcaccgatggctgtcaaggcccctgtccgcatggatgtaatctctgtggcatcgatcacagctctcggtgctccggttttcgggtcatacagattcaaaagcgccatctcagagggcagattctgcttataattatagacataatctcccactaccttcacgcctgccacatccatgggctcaatatatcctctcagcacattaaaatgcccgtgatattccgggttggggatcagatgcacccgcggctctataacggtctttccgttgccctgagcctccaggcttttctccactgctcccagtatctcctcattggtcagattcagattctctatatccattgcatttatgtataataagtccataagcacctccaaattattctcaaactgttactgttccgtatctcacgccttagagtgtgggatctttcttttcctttttcaaatccacaaagaatgtcttgataaatgcgatcaactgcagcagaaaaacaaataataccaggaatcctcccacggaggccaactgtttcaccccgtcgattccacgcacacctcctgcaactgcgcccatgataatggagatggatccgatcaggataccccagatcagcttctgggatttcgggggctcttcctccatactctgtcctttagtacagatagacgcgatggtactggtcatggaatccgccgctgtggaaaaggacagcataagcgtgatcattacaacagggattatgataattccgaggccaaggggcagatgctgcaggaacgcccatacgcctgctgtggctccgctctctttgatcactccaaccatatccactacgccattggtctgccagttaaggccggttccgccccagacggaaaaccatacaataccgaaaacagagggcatcacccagttgatgatcataaactcccgcacagttcttccataagcgatcttcccaaggaaaatccccattatcggcgcataggcgatccaggaacaccagtcagccaaggtccaccatctggtcagcgcctctcctcccacgtcaccggagtccagaccccagataaagaaattgtttagccactctcccagcccggaaacagaattgctgaggataatagccataggtccagtaatgaacaggaagatcaaaagtccgtaaaaaatcttgctgttcaaagaggccagcctgcggattcccctgtccacacccagaatggaggaactggtgaagatcagtgtggcaatgcctcccagcaatatccagataaaagtgctgttcggtattttatataccacattcaatcctgaaattataagggccagtcccgttccaagtccggaagccattcccagggtgatcgccagagagcagagtgtatccacagtattcatgactgccggatgctctgccttctttcccaaaagcggcttcagggtggaaatgactgagagcttttccttcttgttaaaatacatataggcaatgagcagccccgacaccgcatacatggcataaggcacaaaggtccagttataaaaacacctgcccagggcaaacctggctgcctcctgggttcctgcctgaattcccagattgtccagctcaccgtatacatttccataatagatcaaaggttcattaattccccagttcacgatgcccacagcgattccgccggtaagcgtcatggcgaaccaggttccaaagggatatttgggctttgcatttgctccgccaatacggatatcacccaattttgagaatgtgacgatggcgatgaccagcacagatacaacagccacaagctgatacagccatccgaattttcccagggaaaatccgaagaaagccttcgcgccttttgccagaccctcgttattgataaatcccacagctaccaccactgccatcactgcaaacgcaggaataaacacgcctttacgcacctgtccggcggactccttcttatctttcggttctttcattttctacctcccgattcttctcctcttgtgcttttagatattcagttttcgcagaaacgttccctcttttatcatctcacagacagcctctatatcctctgtcaggacacggtcgtctttgtcataaaacggtattttctctctgagaacagcaaatcctctgcctgttacttcccccagtatttttcctttgcgcagatccatggcctggcctgcaagcattagctcaatacctaaaatgtaacagagatcatccagtattttctccagtctcccaacaaccaaaggcgcgttggtactcctgtcctcaatctcccctgcaaggggcagcgtgtccatggaaacaggatttgcaagactgcggatttccgcatccaaagccgtaaacgttttctggatcgtagaaaacgcaatgacactctcctgaggtgacaagtttctggtaagcctggtaaacgccgggtttgccagcttgatactcctcagacaagatgcctttgaaatgtgcgagaaggctatggagagcatctccaggggaagcacccacgcaagcggttcaaagtttgcgctgggagtgatatcccgttcctcctgcaataggcatggattatcatctgatgaatttatctgtatggacagctctttctccgcatagtaaagcgcgtccctcacagccccgtgcacctgggatgtgctccggtaacagagcgggtcctgcagcggccggctgctgtcggcttcgtatagaaagctgcctttcagacaactattcatggcttttgcagtctctatctgtccttcatattttctctttttggctgcctctgtcctaagctgtgaggtattgcctccgaatccttccagagacatacagcttatcacatccgctgttgtcagtattttttctgctctgctaagaacaagacaggcccagcctgcactcagggcattggagcttatcatggcaagcccgtctttctctgccggaacagccggcttcagcccctcctgctttaagatcctgctcacgggcagaatctctccgtgatactccgcacacccctcaccggtgactgccagcgctatgtgtgacagattgccgatatccgcctgtcccacagaccccctcacgggcatcagaggatggatttcccggttcaaaaattcctggtacatcctgacgatcccgggcgaaatgccggtacacagattcaaaaatccgttgagcctcaccgccattactgcccttaccacctccacaggtgcgtaaggtccaacacccactgcatgagagtgaagcatgctgttgttaaatccggtaataaattcttttgtcacttttttatctttattccagcccaccccggtgttgcatccatagatggggattcctcggcctgaaagttcaaagacaaggctcctggcctcctctaattttttccacaaagtttcctccacggaaaccttttggcgtccggctgcaatggcttccaccatatcaggcgtcagactgtctcctgttaaaacaatgatttcctcatctcctttatatattgaatattgtaataacacattttacaaatccggccgaatttatatttattatggtcataatagcacttgattttactcttgtaaaatactaaaatatggttatgttatgagtttttccaatagtaaaaggaggattccaaatgacgctccgacacatgaccatatttctggaggttgccgcctgtaacaatatgagtacagcagcccagaatctgtatatttcacagtccacagtcagccttgccatcacagagattgaaaagacctacaatgtccgtctgtttgaccgtctgagcaaacatctcagacttacagaagccggcctgctgcttctggactatgcctccaggatcatcaatctgtacaaagagatggagtccgctcttctcggactccatctgaaacaaatacatatcggcagcactctggtagctgcctcctgccttctgcaggatattatccgggcgtatcatattatctgtcctgatgtcagcacacgttttaccattgatgactcttatttcatggaaaaaaagctggcccagggagaattggatgtgatgctcacagagacaaagggaagccacagcagccttgtgtatactccatttctggatgatactttcatggccatatgcagtccacggcatccctatgccagccgggaaagtctgtctatcgcagattttgagaatgaattatttctgctgcgggaggagggaaacagtacccgcgcagcactggaacgggcactgagcaaacaggggatcacgctcaccaaaagtcatgtgtatcacaatatcgatgctctgaaggaagcagttgcagaaaataaaggcatctccattatctcaaaaatgctgatctggcaggagctatccggccacaggctccacgcctgcccagtcacagatctgcccatgaaacgcgtcttctacattgtacaaaggaaagacagaaccgctctgccctatgtcaatgaatttatacgcctgtgccgggaaacgtccggacgattgcaatagcccgcatttttcaatggtctcttttttttctcttctatgatatccagcaggatttcctcccacacgcctctgttttcccggagaatctttttgtaagctgactggggaagaggggaatccgctcttccgatctctatggttaggcttgggattcccattttcagcagcgcccagtccttatatcccgcggggtccagctcctcgtaattgccgtccggctcatatccagtgacagcggcgatccggttggcaaaagcctgtgtcctgaccgccagctccccctgctgtccgaatgcccagtatatgactccgcctgaggagtgatagctgaccgtacggctgaagttctctttttttgtgagattcaccagcgcctgagcctccctggtactctccggcgcagttcccttgtacttttccctggaaggccttccgatcccatccacataatcctcccacaaagcgtcgaagttccggttcacatccacgccctccgcattggatttccagcggcaaaaataagacctccagggcattctggccccatcctcgtcggcgatctcccacacctgttcccggatcccgggagactgcatgccttctgccccgaattggctgactgtgaccccgtcgggattggccatgggaataatatgcagtgcccggtctttcaacagttcactgtaggaatatcccttgtaggttctgtcctcatggagcagattctccacaaattcccccatctgttccatgacaagctgggtggtcatatactcccttccatgaattcccccaaagatcaaaaccttgtcagcggcattttcattccccattctcacgtgatatagtttcctgccgtccaccgtgtcaccaactgtttgaacttccataattcctttgaaaattttggaaaatatgtgcaaatcattctccatttctcggtaagtatagcctgaaaattggacaaattgtcgattttctctttgatttcgagcatttatgcacattgacggatacctcaaaactcattataattaaagatattctatgggagggagaataagaagtgaagaagctgaaacaaattgccgcactggttggagccgtactgcttctgggcatgtacgtcctggcttttattttttctctttcgcacagcccaaatgcccgtaatatgctgctggccgccatctactgcacggtacttgttcccgtgtttttgtatgcctgcctgcttgtataccgctatacaaggcagaaaaatgatattcctcagatagataccgtctcttcttctgtggatacctttatctttgatcttggaaatgtgctggtccgttatgactggaaaacatttttaaaaagcatgaagtacagtgcggaaacgattcaggctgtgggggatgcggtatttgacagccccgactgggtggatgctgaccgtggtgtgcggaatgaagaagaaattctccaggcctttattgataatgacccggaatacgaaaaagaaattcgtgagacattcgcgaagatgagcggtgtcatacatacctattcttacacagtggactggctgaaatatctgaaaaaaagagggtacaagatttattatctgtccaacttttcacagcccctgtatgagcgctgcagggaagagatggcctttctgaatatgatggacggcggttacatgtcctggcaggtaaaaatgctgaagccggaacctgaattctatcagaagctgctaaaggattttcatattaaacctgaaaaagctgtgttcattgatgatgtcctggaaaatgtggcagaggcccgttcccaggggattaatgctgttcattttaaaggccggaaagagacgatccaaaaactgttggaagaatacgatgtgcaataaccgcaggtacgcaataatatgcgatatcctgcggcatgagcacactctatgaaataagaaaccgccccattgtatgaaccaatggagcggtttcttattgctgtctattgcatttttatttattgcggtaaataatatcctcacggcttggaccattggaaaccatagtgatggggaaaccgatcttttcttccacaaattcaatatatctgcggcagttctccggaaggtcatcataatttctgataccgcggatatcacagttccagcccggaagtgtctccagaaccggttttgccttttccagtctgcctgttgtggggaactctgttgtgatctcaccgtcaatatcgtatgccacgcataccgggatctcttccagatatcccagtacatccagaacagtgaatgccacgtctgtggttccctgcatacggcagccatatttagaagccacacagtcaaaccatcccatacgtcttgggcgccctgttgttgcgccgaactcaccgccgtcaccgccgcgtcttctcagctcgtctgcctcgtcaccgaagatttcagatacaaaagcacctgcacctacagcgctggaataagccttgcacactgtgatgatcttcttgatctcatagggcgggatgcctgcacccactgcgccgtaggcagccagtgtggatgaggatgtaaccatggggtaaataccgtgatccgggtccttcagggaaccaagctgtccttccagaagcacttcttttccctctttcagtgcattccacagatacagggagacatcgcacacgtaaggggcgatcatctctttatactccattaactccttcatgatatcatccgggttcagaagcggtttgtggtataaatgctccagggtcacatttttagtctcgcatacacgctccactttttctttcagtgccgcatcatcgtcgaacagctcgctgacctggaaaccgatctttgcatatttatcagaataaaacggtgcgattccagacttggtggatccaaaagattttcctgccagacgctcttcctcatattcatcgaatttgatatgataggacattacgatctgcgcgcggtcagaaactttaatcttcggtgcaggtacacccttgtccacaatagactgaatctctttaaacagtaccgggatattaagcgcaacaccgtttccgatgacactggttgtgtggtcgtaaaacacaccggacggaagagtatggagcgcaaattttccgtaattgtttacaattgtatggcccgcattggcaccgccctggaatcttacgataatgtcggattcctgtgcgagcatgtcagtgattttacccttaccttcatctccccagttagcccctactactgcttttaccattttttattcctcctaatgaactttttgtacccatgtatcatactacatttcttttaagaaataaagttctaatttgtaaattcagatgaaaaattgtggattttcatgggaaaggagccgttttccccgtgttttggcggttcaaagcggctcctgccctggtctgaacagaaatctgactttctgttcagctgttttttatcgaaaactgttagtcaaaatgcacttccgcggcaaattttgccttttcatccatcaatcctttgaatccatcctcctgcttgcgacccttcagctcatccatatactcatcgtaatcgcataagtagacgtagactgtggaggtatcatggtttttcactgatacggtgttcacagagcctgctgtaacatccataactttgccctgagcatccaggatgaccgggaaataatccgcaccttttgtttcatcatcatacagctcatttactgtgatctcaaagggagtcttaacaacattagcaatgcctgcgccggcttcattcatctggtccacctccgcagtctgggtcttggaagggtcggcagtgatatcaagctcaaactgccaggagccttccatccaccagttttcgtggctgtttgggaagctgttccagccgccttcattttccgcctctgtcatgacccggttccactcttcatctgacatggcttccagttcctccgccgtgtaccctgtactgaaggtatctggattagccaaatctcctatgatctgactgatgtccaaattcagggtgaactgttccggtatctctaatttggtgctgtactgatccagcacttccgcgtcaactataaattcttctccgtttgcctcagcctctgcggccttttcctgcagctcgctgttatctgtattcttcatgttcaggtctatacgcataacccctgcataggtattttcatccaaaaactcgccttccagatagacaaggtcagactgttcctgaggattaaaactgtaattttccgttgttctcacactgatagatggctgtccgttcctattcaggagggtatcctgaaacggttcctctgattctatcacgagggaaaggtacagagccgagccgctgcagtagctctcagacatgctaaccgtagtgccgtctactgtcctggtgaatgccccttttccggcactgccgtcctgatcactgctgctctgcccgctgttttcctgtccactgttttccttcccgctttcctggccgccgctttcctgattttctgctgcttccttatccagcggttccgcataatccttataattttctccgaaggcgagttttccttccattctctcaaatatatgtccgatcagcggcagattggaagcccacaccggattctgataacaggccccgataaagactgccatggcagcggcagcggcggtacagcccactgctgcttttttcaaacgcccgattcttcgtttttccttcctgtccatcctgatgatctcagcgccggcagatgctttctcccctgcgttctctgcctttttctctatcagtttcaaactctcctcaaatctgttatgaaattcctctgaaggctttggtgctccctgtccccattttccctgctctaacataatgcttcctccttatcaccaagaatcttcctaagctggtttcttcccctgtaaagccgtgttttcactgtattttccctgctgcccagcatctttgcaatctctgcaatagaaaatccttctatatagaataatgtcaccgctacacgcaggtcttccggcagatcgtctatggcgtcatagagatctgtatacagcttatcctctttccccggctccctctccacatactcctcgtaaggaaccagacgtttctttttgcgctggatctgataacactcatggatcagaatacgggtcagccatgttctgaaatatttctcttcattcagggtatctaatttttcaaaagcctttaaaagcgcttcctgcactgcatctgcactgtccgcttcatttctgagaatggacattgccacgtggtacatggtagtctccgcgtctctgacggcttgtataaactcctgctgctgcatggttcctccttttcgtacaccgggcagggtcatcctgccggctgtaaaaacgtgagctccgttttttgtacacaatagattctgtttttgccttatctctattgttattaattagataccccaggtgataaaaaggttctcttataatttcacataaatttttgccagtaactgtgagggtactgagcagttacacagatattataaatagtcctcaccgccacatgcaagttaaaaaacctggcacagggcttcacaggttctctctgcaagacaaaaaagcacctgtcagcccggatattaccgagctgcaggtgctgccttctcaacattttttattctctggtatttttttctactatatttacaatcctgtctgcttcctccctgctcttggcctccgccagaataaaaaggcctttggaggaaagctgttccatggcaggctctatctcttccggttttaaaagcagaagaaggccttttcccttttcctggatttttttgagctggtctataaactgcagcggcgagggctgtcccaccacactggtccactggatcatacgcagcttctcaacagacagcaatgtatccaaatgccggatctgctccattccgtcgaaatgataaagaggatattcaagaaatccgctctgcttctccaactctcttctcgcgaatttttcatagatatcattggaaaacattacggaaatatcacactgtatctgtccgtggaacccgggtgcccaggtgcgcagccatcctattgtactgcctccatggttacagtcttccacaattttgtatgtctcttccaatccggcctcccacatgtgctgtatcctgtccaggcattcccggatgaccgcttcatcttctgcaagaaaatccaccaacagttcctgtgagcctctcagggcagccagaacatccatattgcccgccagatccggcatggagataagatattctcccctgcactcatcccggaaatatctggcatgctccagtgtcttctgaaaaaggaaactgttttcatcgaaaatgatcctctccggattcagttcgtcctgcataaatggcgtgaaccatatggtactgggttcatagctccatttcatattttttacaaaccccgcatggccggcaggtcccagattcagggataccagagggaaagcatctcccgcataataagtattgtccatatgactgagatttctttgaagcattatctccgggtctgtccagtacctcatcctgtcttcactgcccaccgggaaagcatctatggcctgtctcttttccggctcctcatatatgacgctgacacagcacctgtccaatatttcatggttccagagagctgtcatacgctcttttatcctatcaaaatccactctcatttacacgtacctcattttctctctgcgttatatttttccatagcatcctggaattttgctgctgcgtcctcaggcgtggtcgttaagccgaataaatcctgacaggtatcgagatgcacctgtcctacttccggcggaagatattggtcataccaaagctgtgtagccggcgcacggttcactgcatccagaatctgcagacagacagggtcttttatcatatcctccacaccttttaccggagggatttttccctgttccaccatcagctccaccatatcatcgtcaaaaaatgtctctataaattggaatgccgcctgctgtttttccccggtacagttaaaagtaaaaaactggtctccgatcgttcctatgacaatatcaccgttctcctcttttccctcgatggcagggaatggaaaccatcctactttttcataaaattccccgctctcagactgcatggtactggtataccaggagcccatgagtatcatggcagctttttcctgatataatagctgccttccctgtccgtccccttcactcagactgttgacaccttccggaaaatagttcttttccacccattcctgaatcttccggccggcataaagaaagctctcatcttcaaaactgccctcccctgccacagctttatcaaagggttccagccctccctcccgggcggccagggacataaagaacatcgatcccgtccattttgcttcatttgccagggcaaatgggatttttccgtttgctgccaaagtatcactgacttgctcaagctctgctactgttttgggaacctccagtccatattcctgaaacatttccttattataaaagataccggctatagagtcgttcaatacgccgatggaatacatcttccctttgtactgtccctgtgcgatagctgcctcctgcatcttatctttgatctggcttttgtcaaaaagttcgtctatgggctgcccgtaccctgcttctatgtattcattcatgggtccgcccgaccagttggcatagagatccggacattccccggaactcatggctatcactatcttttccttgtacacatccggctcagatgcaacggacgtgatgtgatatccgctttttgtactttcattaaatttttttactgctgtctcataaatgagtttgtctgtctctcctgtacctgtattccagaacaggatttctttgctgccctcttcgtcttggccggaagtgtctttatctgcacccccgctgtttcccccacaccccgacaaggcaaatacagcggataataccgccaagcctgccgttatactaaaacgccttttcatttttttcttcctccttgtagttttgccctgaatttataagtatattattacattcacggcgacactctacaagataggaagacgacaatcattaggactattccgacatctccccattttgccttcttgtctgactgggtgaaagatgaaatctctttttgtaaaccctggcaaaataagaggggtcctcaaagcctgactcctccgccacaatgcggatgggccgctgggtgttcatcaaaatggttctggcatgcttcaaacgaagctctgtcagatattcgatgggagacatgccgcactcctccgaaaatacacgctctagctgtcttggggaaatggtaacacttttggctatatccgcaactttaatggacgtattgagattagaacggatataatgaatggcgctggccagtatcttcattctgtccgacagatgctgttctgtcctgtaattattggcaatgtaggagataagtgtcttaaccccatattttactgccacataatactgacctctggcatccctgagctgttctattataaaatgtcaagacaaaatgtacaaaaaatatggtataagaatgtacattaatcttttggttgaatgtggtttcgcaaccggtaagattttcctgatattgtaatcacatgggaatgatgaagcactctgtccaaaatggcattggacacaacaacatcataaaagatctcatcccattcattgaaattcatattggttgttaaaatggtacttttcttctcgtagcgtttatctattatttgaaagaaaagattggaatcctctttgtcaatagggagatatccaatttcatctatgatcagtagtttataatggcaaaaatgcctgatccttgtatccagtctgttctctaactttgctttttttaattgctggagaagatcgtggcatttaatgaaataagtactgacccgttttttggcggctgccacacctatggctgttgcaagatgggtctttcctaccccgctggggcctaaaaatactacattttcacttttttccaaaaatccaagtgtacacagttcccgtagtttctgctcactgatattcggttgaaattcaaaatcataatctttcaattcttttacaaatggaaaagcggcagctttgatcatggaacgggatgcgttcttttctttaaaatccacctcataattactcagtttcagtaacccttccgtaaaagaaagattatttactgtcacaaaatccgtgatttcgtccaaatgcaggagcatctgggtaagcttcagctgttccatgttgctgcataattgtgtatatgctgtattattcataaccgtaaattctccctatggtctccaaattttcttttgctctgtccacgatcttttcgtcccggaaagcatgggacattctggcaatagctgtataatgttctgttttataatttaatttctttttactgattgtatgtatagttatgaattctgtgctataataaacatggatataaccatcatacacttgcaaggtgacttgttttcccacatactttggtggtacagagtattggtttccctgatagtggaacagactggaatgatttacttttgctgtgtgacaggtgatctgataaggctttcttatggtatcagcgggcaggctgcgtaagaaagccttttcttttgcaaaatacagcagagggatacgtccggttccctggtttacctgggtatttacccggttgtttatccgtttcactaattcatttaattcacaatagtccagcttcccattataggctctaatctcgtccaatattttcatgggcgcttctactttagcttttgtatgcggatgtccggcaatacatggatggatgtgaaatccataatcatctgcaaactgctggaagcgtatatttatctttccgtcagaatattcagtccttgctttatccataacagtcttcatattgtctgttacgatttctttgggtacaccgccaaaagtttcaaatgcttcatccagaaacgagaataggatatcctgtgtttttgtgagagatactttatagatacggaatcgggaataagatagcagaagaacaaaaatattcacctctatcgtttcaccattggaaagaagaaaaggaatggattctttccagtcaagctgagcctgttttcccatatccgtttcataacgtaccgtgacctggctgacattggaaggtctgtgccttctgaaataagaatcaaactcagggtaagtttttaaataagagcagaaattgcagtatgcaccagaatagttatgattatcaaccagatactgccacaggactttacggtaataaaatacctgctgatttcggtctgagagcagctcttcaataatatcgtaatgggcagcaatacaatctctcgacttacggactgttggcttctgatagccgttgatatatttatccacagtgcgacggtcaacttccagttcccgtgcaatctgacttttgttaattttcaaagtagaatcctccaaaaatggttttaatttatataaatctttgacactatgtatttcaagatctgttatgatgtgattttttaatatcattatgagctcctcctgttagctcatgtatcataacatttgtacatttttattccacactttttgtacattattaattataactttatattctatcagaaaatccgccaactgttccaccacctttactgtttcatcctccatggtaacacgataggggtatgccagatggggcagccattccggctggataagaaacatatagtcaaagccctctataaaacgtagttcttcattctcaccgaagagcagccggggatcatacataatatttattattttcagatccttattatttctaaacccatgcttcacgtctcccttgatgacaaatacatcgcctcttccaaggcggtacacctgctgttccacaagatgctctcctgaacctgacaccacgatcacgatctcatcaaattcatgggtatgctccataaaatcctggttcactgtgacccgctccacatacatactgtaatcccggaacgtctgatattcctgtttcaaatattctttcttttgtatgaacataaaaacctcccgtttgattccccatagtatctatatcatataccaacagaaagaaaaagacagccatattccaaagaatatagctgtctcacaaacatttcctaacagttcactctttatcccgccaattctctcctgcggaaaaggataaatccgattgcggatacccccatcaaaataggataaaacagatacggcatgatcgcaataggcgtcagaccggacaaactagcagcagccagaagctgggcgccgtaagggatcattccctggcctacggatgcaaagatgtccagaagggatgcgctcctttttggactcaccttgaactcctcactgatctcctttgcgatgggacctgccataacaatcgccaccgtattattggctgtacagcagtccaccagcagagccagaatggagataccaaactccccgccccgctcgccgttgatccttttcttgatcacgttcaggatatactcaataccaccgtgctccttcaccaaagccacgatcgccgccacgataatggatatcaccgtgatatcatacattccggtgatgccgtcccccatcttctggaacatttcgctgactgcaaacgcgcctgtaccaactcccacaataagggacagcacagtacctgttatcagcacaatgaacacattaatgccgatgagcgcgccgatcagaacgaccaggtacggaattactttaataatctggaaactcagatcgtcgtcaatgatcccggcatttcccctggcgataatgaagaagatcacagcggtaatcaccgctgcaggcagaacgataaaaaagttctccctgaatttgtccttcatctcacaaccctgtgtcctcacagccgcaattgtggtatctgatatcatggacaggttgtcaccaaacatggcaccgcacacaatagctcccatgcagatgggaagagggatacctgtcttctccgcgatccccacgccgataggcgccatggctgtgatggtacccacactggttcccatagaaatggagataaaacagccaatgataaaaagccctaccacagcaatggatgacggcatgatggaaagtcccagattgactgtgctctccacaccgcctgccgcttttatggacccggaaaaggctcctgctgccaaaaagatcaggcacatggtgacaatattctcctcaccgatccccttggagatgattgccaccttttcctggaatttcacttttcggttctggaaaaatgccaccgtaagcgcgatcaaaaatcccacgatcgcgggcatagtataaaagtcatggaacagaatacctgctccgataaaaatgatcaggaacaccccaatgggcaaaagtgctataggattcccccgcttttgctccttcatgtaaaaacctccgaattgttttttctttgtattgttatacgttgatctctgcagtcattcccaggatttctttgttgtcatccagtaccggctgcacaacatttttcaggaacgcctccacctgtacctgggcacgccctgtatagcgggacggctccatggtcttctgcaggtcttccagactcatattgaatgcaggatcagcggcgatcagctccagaaggttgttctcttttccttccacttttacatttttgcccgcttccatggacagctcacggatcttctcatgaagttcctggcggtctccgcctgcttttactgcgtccatcatgatattttccgttgccataaacggaagttcacttctcagacgtttttcaataactttcggatataccacaaggccgtccacgacattcaggtacagatccagaatgccgtcaatagcaaggaatccttccggcacagaaagacgcttattggctgagtcatccagagttctctcaaaccactgggtagcggaagtgacagccggattcaaagcatccaccataacaaaacgtgacagggaggcaatacgctcacttctcatggggtttctcttataagccatggctgaggaaccgatctggctcttctcgaatggctcttccacttcttttaagtgctgcagaagtctgatgtcattggagaacttgtgagcactggccgcgatacctgccagtacattcagcactctggtgtccacttttctggaataagtctgtccggatacaggataacactccttaaatcccatcttctctgcgatcatgggatcgatcttgtcaatggtctcctggtccccgtcaaacagctccaggaaactggcctgtgtacctgtggttcccttggatcccaacagcttcatagtgctgataacgtaatccagatcttccagatcaagcataaattcctgcatccacagggtcgctctcttacctactgtggtgggctgtgccggctggaaatgcgtaaatgccagagtcggaagggctttgtgctcgtccgcaaactttgcaagctctgcgatgacattgatcagtttcttcttgaccagcttcagagcttctgtcatcacaataatatctgtgttgtcgcctacatagcaggaggttgctcccagatggatgatcccttttgcttttggacactgaacgccgtatgcgtatacatgtgacataacgtcatggcgtacctgtttttctctctcttttgccacgtcgtagttgatgtcatccacatgggctttcaactcgtcgatctgttcctgggtaatatttaatcccagctctttctctgtctctgccagtgcgatccacagtcttctccatgtgcggaacttcatgtccggtgagaagatgtactgcatttctttgctggcgtaacgctcggataatgggctttgatatctgtctgtactcatttaaattctccttttttctgtttatcttataaaataaaaagggcgcacgaggcgccttccgagccggaaggtgtcccgggcaccccactgatcaagccaggcccagacgtttgaatacttcgttgtatgcctcttctacattgcccatgtctcttctgaaacggtctttgtccagcttctcgtttgtttccacatcccacagacggcaggtatccggtgaaatctcgtccgccaggatgatggttccgtctgctaatttaccgaattcgattttgaaatcgatcagcttcattcccgcattcaggaaatatttgatcaggaattcgttgatctttcttgtataatttttaatggtgtcgatttcttcctgtgtagccagtcctaatgccagtgcatagtcgtcattgatgaaggggtcgcccaggtcatcatctttgtagctgaactctaagatcgggcagagaagctgtttgccctcttccactcccattctcttggagaagcttcctgcagccacgttacgaacaataacctctaaaggaacgatgctcactttttttacggctgtctcacggtcgctcagttcttctacgaagtgagtcggtacgccttccttttccagctgctggaaaacatagttggtcatgcggttgttgatagcgcctttgcctacgatcgtgccttttttctcgccgttgaatgctgtggcatcatctttgtaatctacgatcacaacgccgtctacgtctgttgcaaatactttctttgcttttccttcataaagctgttctaacttcttcaccttcgtacacctgtcctttttccataatattaatttctcccaccagagtgtacacagcttgccgaaagcagtttacaaacactccttggagaaacgttacgatacacaaggaattatataacatcggttttcaaaacacaagcctaaaatccggtgcttctgtggtattcttttgtgtatttttccaaaacagcccctatatcctcctgcttctcctgggaatcggcagctttttgggattccatctctttccggatctccctgcaggtctcaagatccgcacccattctggcacattctccctgccactgggcctcttccatgatcatcctgcaggcacacagataatgcttcaggatccgtttggtgtgaagcttttcatatgccttttcaaaacaggatttggcctcatccatctggaaaagatacagataggcacagcccatattgtgataaatctctccctcatactgtccacccaggcctccggtatccacacttcggagtgcgtcctcgtaaattcgtatggcatttacgaacattctgttgtcaaccagataatcaccttttttcttcttgcgcgccacatcgggaagctgttccaaaacaacaagttcctcattcagctttttaaactgctcatgggtcaggtaattgatctccctgaatacagccaggataaaatcccctgccccccgctcctcctccaggatccggtacagcttctggtagagctttaaaagtcccagctcgttctttatccagtcgcagagatgctcattgatgatcgtctcgtccagcagataaatgttgtggtagagataataacataattcttctatgctgtagatattcgtgctgatgttctcaatataaaacggaagggaagcccgctttatctgacataatatgtatccgctcatctctttcctcctaccacgctgctctctcggtccacatcaggccgcttgaggggaacatctccccgaatcccagatcctgcaccagaataatgcaggtgtccgcagattcatacatgacatgtaccctgagtcttgtagtcctgtcaggccttttcggaagtcccggcagcttcatgcagtaatgtctgacttccccgccctccataggcttcaccatgaattccagatcctctctgccgtccagaagcagttcaaactcatgctctgtctcataccagtttcttcccgcttcagcaactgtataattcttttttgccccctggaccagcatttccatgctcacatggttctgcaccagagcatttcccacatacagatatgtgcccagaagcttctcctctgtccgctctcttgccgcgtagcaggcgcccttcacatacatattatttccataatatacatggcgctggttcttgcacagaaggggcacgcttctcactgcccactcctttgaaaagccgtcacctaccagatatattcccacatatgtgtcattgccgcaggaatccgctataagctgataaaaatccacatctttctggtccgggtcttcgggaagggttatggtcttaccgtgctccactgtgaccagcatgggttttttctggctgtcaaccaccatgcgggagaaagaaacctttcccttttcaaatgtgaaaagtcctgtcatccggttccagttgtccagtctcttgctcatcacataatagtaaaagctctcctcataatcctgcagaagcacctgtccggaggtgaatttcagacggctgcacactctctgaagcttgcgcaccagcacccggttcaggtccggaacggttatcatcagcgttttgatctgtcttgccggctctgctacacccagaacggacaggcagccctttagatagatttccagcaattcctcgggtctgtaccagcccccgtctatctccaccggttctccctgtgcccagatttccagcaggttgtccaccgggatttccccctcatgcatggaaaaataatccgcctccataccgaagtgccacacctctgttctgggccttttggaaagcctggttgaaaatgtatactgattgctgcctgtcttcacggaaatggagacaggctctttttcttttctgtcataatagcagatctgggaaaattcttttcccagttccaggcctgcaataatatttcttgtctcattcatgccctagtctgcctccttattctatcagttcaaagagagaggaaacccacgcttcctgctgcctgtactgtccaagcagttccataagctcctgctctctcccctgctgtttcgccgccagcatacggttgatcatctggtacttggtagtcccctccagctttgcctccggaacagtgagcttgttctttccggtctctttaacttccccgcccgctgagacagtaaagtaatactccagaacctcaccgaaaaacaggataaattctttattataaataccctgatacagatttttcagaggttcttttttgaactctcccggctccctgtctgcctgcagcatgcggtagtaaatggtcacatccgccctgggactggcctgacactgggcaaacaccttgtcttcaagctgcatgctctgcaaaagagttctgggaagctcctggaagaaggcgaatttaagccctgtcctggcacatatggtcagaatggaacgggctgtctccagcctgctttcttcccatttattatcctccgcatagtatttgagaagggccaggtcacatacaatatcgtactcccatccttttttcctcacatgctccaatgagcggaaaataaactcctccgcctcttttccccccacaaaatactggaaagatgcaaagcttaaatatgccagtatcacctgttccttgccgcttaattttacgtaatctttcaggactgcagcgtcttttggatgatagatcctggtaaacatactgtatgtcagaatgtcttcctccagctcatacgcctctatggaaaatcccatggagcgctcccatacccggatcatctcgtctacaggtccttcaaaatacttggtcaggtattcaaggaccacctcatcataggtattctccctgaatatatggtgagccagtaaaagcagctcctcctcgtattcaaactccagattgagtatcatacggctgcacagcctaagcaggtctctcgggtctatctcctcatacccgtattcacacaacagatcataagcccccacatacatcccctgtttgatcaaaatggtgatgagcaggctcttgttgacctttgcaaagctgtgaaaatccatctctctcagataatccttcagattgtcgttgtccatatgctcctcgtagtagagaagcagacgtctgcgcactctctgcctgtaatcctcagagaagcattcctccccggaaacatcctggatgcaggaaatgttctctcttgttatgggattctcgtggttcagctcaccgcaggtgtagagcagaagtccgggggttctgatcccttcagccaaaagctgtctcgccagttcttttctctccagaagaggctggatattgtaatctatggtctggatataacgtctctgcctgtcgtcctcaaagacgatcctggcgtccggcgtgtaaatggacacataggccactttgtccgtgcaggtatacgtctgttcttcccggaaggccgcatgacggacgatcacccggcgtatcttgggatcatcacagtaaagtctgtgggtgaaaagcaccttagcaagagctctcttcactgcgggatcatgggaattcaaacagaattcctgatacacaacagcgaaatcctcattcatcctgccctctttgagcttctcgcaggcaaactgttccatactgcttttatagcttagataagtggtcttgtccacttccttattgcgtatcacattgctatacacaaaggcttttttcgcgtcactcaaggtattgttatagctgaaatacatgcggatcatgcgcggaagcatcttctggtaattgcggctcatggtctcaatataatactcatacagccttgtgatcttcagctctttttccactgccagctcataccagcggaagtattccttcttcctgggatctcccttcatgatcagcatacagatggagcgcaccacggctgtagatggaaatttctcatagatatattccagaatctcgtataccttccggctgaagtccttcatctgtccggccaggtctgtagctctaaaagccatctcctctgtcataatgtcatgccgcatggcaaagagcagcacctggatggtaaaggggctgatcctgcgcagcagtgccccgtcccctgctgcaatgcggcacgcttccagatagagaaacgggcttctgcagccggttctgtactgctcctccagcagatagatcttcttggactgggtccgcacctgttcggagtccgtcttcagcaggagatacagcagaaggaagctgtcctccctgcgctggtaaagctgatggagacgcactaccatcttctcccggatatcctggctgcagcccaatatgtcctccagatagagataaaccccttctaactcctcctcagcctggatccggctgttgtccttcagcttatcaaaggcttctcttgctttgccatcctccccgcattcatggtagaaccacacttcaaataactggtgttctgtggtgtaatgcccggtctcccgaagctcggtgagaagttctaaggtcttactctcccactggctttttgacaatttttccaggctgtgatccagataatcccttaaaagctccagtttctttttcttctcataagccgtgacattgacctggatcttgccgctcttggaagccatgacctcgtatacaagggtctggtaaacggttttgatacagatcctgccgtaattcctgccccggcccaggttctctctgcgaataatatactccagctcataaacgctgccgataaaatcctcgtcccggatggactttttctccacttccagaaaatcgccttccacactcacactggccttcagatatccccatccgcttctgcgcacacggacgctgtccataagagagctttgcacctcataaatctccagcttttcctgctccagatgaagtttcacaggctcttttttgcctgtaccgatgaggaattcctccagatgctgccaggtcacaggattcttggccatggcataatagtaaggcagaacctcctgttcctctttcagaagttccggaaaggaatcgtccaaaaacaggtggtacgcctctttaaaatcctttttcgccagctctgcaaaggcatccaagtccctgatggagccggctgacgtcttgatgcggcagggctctacctgtatatgaaaggggatcctgtgctcaccgatgctggtactcagcaccacttctccctcaaaggaatccccgggattcaggccttttacatcagctccgtacggaatctctatcttctccccggtaaaacgctcttttcccagaagaaaacggcgatgggaagaataggcgatcccttttatgcgactcccgttctctgctgctattatcagctttcccctgatattttcccctgcctttgtgcgctccctgatctcttccatggacagcaaaaggcttggaacctcgtattcaaatcttccatttatcagttgttctattcttctcttcaatgtattttaccccgttatctccctgcctgcaaagggccggagaatctccgattcttaacttgtttttgatgatctatcccactatctcataagcagaagtgggaaatcctcgtttattatattgaactatttattatatcccgctataatgtgggtaagtatatattttcaggtataaatcctgaatagtacaattatacactacaaacgcatggggtgcaacctctgccgcccctccaataactccataaatacgaaaaataaaaggaacggaggcattcatatgctgaaacataaagaccatttccacggcagtgacctggaaaaaatcgaagaaatatacgggatcaaaaaggaggatatcaccagtttctccgcaaatgtaaaccctctcggcatctctccccttttaagggaaacactggcaagccatgtagatgccatctccacctacccggaccgggactacacaaaactgcgaaagagcatctgcgcctacaccggtgcccagttcgagaacatcatagtgggaaacggctccacagaacttatttctctgttcatccagactacccatccggaaaaagcgctgatcctggggcctacctactcagaatatgaaagggagattgccctggaaggaggccacacgctctattatccgcttaaagaggaaaacaacttccagatggatgtaaatgatctgtgtgcccagatgaaagacggcctggacctgctggtgctctgcaatcccaacaatcccacagcctccgccatctccagaaaagacatgcggaagatcctggacgctgccctgcagttcggcatcgcagtcatggtggacgaaacctatgcggaattcgcccctgatgacaggaaaatctcttccatcccactcaccaacaactacaacaacctgatcgtgctccggggaatttccaaatttttcgcagctcccggcctgagactgggctatgctgtcaccggcaacccggatttactgaaatacatcaacaccaaaaagaatccctggaccatcaacagcctggccgagatcgccggctgcatcatgttctccgacaaagaatacattgaaaaaacccgcaccctcatcaccacagagcgcgagcgccttctcagccttctttcttcctgggataccgttaaggtctatccctcctgcacaaactttattcttatgaaaatactgaaagaggatgtaacatcagatatgctgttcgactgctgtataagaagagggcttatgatacgtgactgttccacatttccgttcctggattcttcctatgtacggttctgcgtaatgagtccggagaaaaatgatgaactgatgaaggcttttaaggaattgctttaaaacatttcatcgggtgggggtgttggaaaaagggacgggatgccggggtggggtggtgggctctgttggcagccagcttcgttccccttcaactaagccctaacttcgactaagacgctcagtaaagacttcgcgcctaagtctccgtaagggctggattttcaggctctctaccgcaatgtctgccaacagagcccaccaccccaccccaacatccctgttcttctcaaccggaagataaaaaaaccggctactcagccagcaataataaaagggaatataaaaaaacaaaaaatgatatttctttttttattttctttttatttcctaaacctgcggaataatgcgtaatactgtggcatagtgacaaacaggaaggagatgggggagggccgggggaggaagatgcatgggaacgatgtctcagtggagcgccggggagatccacctgccccaactgcttaatgaagaggccaatgccgatgaatttagcagatgggagcaggttagctccgtggcagcggaacgcttcgttcacaggcatcttcctcccccggccctcccccatctccttccgtccgccttcatccgccttattccgccttattccccatcatccattcaattccgcagccaactccctcaccgtcttccccaaaatcggatgtctcttccaccccgcgatctccgccagcggaaccagcacaaaatcccgcagatgcatttccacatgcggcacgatcaattcttccgtatcaatgatctcatcgtcaaacagcagcagatccaagtccaaagtccgcggtccccagtgtaccaggcgctctcttttggcggcctgctcaatctcatgcatccgctccaaaagctcaaacgggttgtacagagtgcgcatgctgagacaggcattcaggaaatcatcctgctccactccgccgtagggttccgtcaccaggtaatctgaaactttcagtaccttgcatccaacggtcttgtccagttcttctacagccatatccaggtatgccttcttatcccccagattggagccaagggcaatataggcggtatgccaaccccttgttatcttcacggacacggttttcaggggaagtcccacaggtgcccatggtttctttatttccagggtaacagcctccagatgggcaatgcttctgagcatctcctctgccagatgctccgcagcagcctccaaaagcttgaaggtatgcttctgcatataagatgtgatgaaatgactcacagcgctgtaatcaatggatgcctccagctcgtctgttctgcctgcccgcacagtatctgtgtataatatggctgagaccatgaacttctgtcccagcttattttcctcgggaaatacaccgtgatttgcaaatatttctaaatcctctatggttatcttatcaaatttttccagattcatatgctacattccctttctttcccgcaggatcgcctgagtcatgcgaatggcgcgcaggttttcttttatatcgtggactctcacaaaggccgctcctttttccacacccatgacagtggtcacaagggtgccctccaccctctgatctgcgggcagatccagagtattgccgatcacggattttcgggaggttgccagaagaacaggatatcctatctccttcagcatttccagatgatttatggctgccagattgtgctcataattttttccgaatcccacacccggatccaggatgatcttatcctctgccacacctgcttctcttgcgatctctgcgcattctctcaggtccatacacatttccttcataaaatccgtgtactctgccttctctctgttgtgcatcagacaacagggaacctgataacgggcggtaagttccgcgacctttttgtcatacttaaagccccatatgtcatttaccatatctgcccctgcttttaaggctgcctccactacctggcttttgtagctgtctatggatacgggaatgtcaaaatcctgcttcagcatctcaatgacaggcacaacccggtcaatctcctcctgcacagtgatctgctgatgacccgggcgggttgactcccctcctacgtcaacaatggctgccccctcggcaatcatatccgcagcatgctgtcttgccctctccatgtcgttccactttccgccgtctgaaaaggagtccggggtcacatttaagatacccataatatagcagtcatgttctgtgtcaaatatcctgtttccgattttcatttcctgttgtctcctttttcctgtatttttactgccggaaagcgtttaaaactgctctctgcatactgtaacacgcagcttgcaggaaccccttcccaaacgcactccggcgcagtctatatcttctgtttcttcaatacgctcacactgtcaaatacatatttttcttttccgcgctccagttgcactctgcctctgcagggcaggaaaagcagcacctggaacccttgtccgcccggtagaggattcccgccagatctctggcagctttcacggaggcatcccggtgtcctttgatggcatccaggatctcctctgtctccgcatctgaaaacccgcactcccgaagtatggggcctgcgatcatcactccgccctcatggtggggaatgccctctgtgtactgcaggcctctgcctatatcgtgcagaagggctgccgcgtagatcatgtcttttgaaatacccagacccatctccagattctcaatatacgcaagtcttgctgtatccaacagatgccggaccccgtgaccgcagaaaatacgttcccgctccagctcttctatattatgtaaactgctttggtaaacagaatgattccatatcctgtttacccttgtcatatccctgctcttatctttcaatttccggtcctcttttgcccatatatcgtaataatactgtctaaacttattctttttatcagcagtccaacattcggtaaaaggaattctgcaggctttcattgtcatcaaagacacctcttgtcaccacagataccgtttttgttcccggttttttaattccccgcatggtcatgcacatatgctctgcctgcaccagcaccatcacaccctttggcttcagctcctccataaaagcatccgcgatctgggctgtcagccgctcctgaagctggaatctcttggcaaacacctccactgtcctggcaatcttgctcagacccaccacttccccgttgggaatataggcaatggccgcgttcccatagaagggaagcatatggtgttcacagaatgaatagaaatgaatatccttttccatcaccatatcattgttgtccacatggaaacgttttttcaggtgcacaccggcatcgtccgtatatccacctgccagttcctcatacatgcgggcaatcctgtccggtgtctccaaaagtccttctctgtctacatcctccccgatcccttccagaatcaagcgtactccctcttttatcttatcctggttcatgttttttctccctccatggcctgtacttcccggtcaagctcccctaaaaaggacagggagccaaacgctacgatcacatcatctttctgtacattttccatacttttttccaccgcttcccgtatgctgcccgctgcctccacactgggattgacgcttctgaccgcatcccttagcttctctgccggaagtgccctgggattacccggtgtctgtatggtgataatatgctttgccagaggcgctgtcatccggatcacactctcatagtccttgtccgcgaacacaccgaagataaaatgcaggtctctccctttaaaataagtctccagtgaatccttcagcaccttggccgcagccggattatgggcaccgtctatgacaaccaccgggtttttgtggatcacagaaaaacgccctctccagaaagcttccttcatgccctttctcacctgttcctctgacaaatgatatcccagcttccgcaaagcctccacagcctccagcgccaaagccgcattggtcacctgataggttcccgccagcgtgatttccacattttcccagttcttatatgtaaaggtctgtctctcatatccatactgcacatcccgaaaggcagccgggtccacaactgccagtctgcagtctttttcacggcacacccgctggatcaccgcggccgctttcgggtcctgttccgcgctcaccacccatgtgtggggcttgatgatccctgctttattctccgcgatctcctgaagtgttccacctaaaaactccatgtggtccatgccaatggaggaaatcatctctatcacagtggttttcaccacattggtggcatccagagtgcctcccagtcctgtctccagcactacgatgtcacatttcttttctttaaaatacaaaaaggacagggcagtctccacttcaaataccgttggatttcccttattctctgcctccatggcatccactgcctctttgacgatggtcaccagggcagccagagtttccctgtctatcatttccccatccacctggatccgttcccggtaggcatagagggtgggggagatgtaccggcctgtccgcaggcccgctccggaaaggattgtagacatatatgagagtgctgacccctttccattggtaccggaaatatggataaacttcagatcatcctggggatttccaagccgcatgagcagctctctcatgttatccagaccaagtacacttccgtatttggacacttcatccaaatatactcttgcttctttgtaattcatgtatctcctatccgaggcggccctcttttttgtccgtctctatatcgttcccattatattacttttcgcctgtgtgttcaagaaatatatcaccgcagccactgtttaaaaacagcgctgcggtgatatggaaactctaatatttttttaggtcatcctcatcttcctgatcgatctcctttaatcggatgacaagcactgcgatcagcacgcctatggctccgatccctgccagtaagaaaaataatcccatgggcgcaaatccatccagattcgcagtccccagcaaaccggacaccgcccacaatgtgatcagcagactcacgacgattgctacaataacaggtgctatttttttcttcacggcatatccctccctgccctattcttactgaaagtcaaacagtgacatctgattggaatccggcagatcaccaaacagccccagatcatccataaggtcgataactgtcttgctgaccttggtcctgttccggaaatcatcttttgaaaggaactccccttcttccgcggcgagcaccacggcgtcggcggccctgtctcccaagccctctatggtgtcaagagccggcatcagtttatcatccatgatctgaaaggtatgggcattggccttataaagatctatgggcacaaactcaaatcctcttgcgtacatctcctgcacgatcttcatatccctgtaagtatcctgctccttcttgctcagcgtatccttgcgtttctcatagtcatccataaaatactccagcttctcttttccttggcacatcagctcataggaaaaggccgttgctcggatactgaaaaatgccgcatagtatgccagcggataatagatcttacagtaggcaattctccatcccatcataacgtaagccgcagcatgggcctttggaaacatgtacttgatctttttacaggactcaatataccaatccggcacatcgtgagccttcatatcatcgatccagtccggcttcagaccctttcctttacgcacactctccatgatggtgaacgcctgcccgtgctccagtcccttgttgatcaggtagatcataatatcatccctggtacagatacaggttgtgatggtcgccgtccctgatttgatcaaatcctgggcatttcccagccacacgtctgtaccgtgggacaggcctgaaatacgcacaagatcagaaaaagatgtagggttggcgtcgatcagcatctgcatggcaaaatccgttccaaactccggaacacccagacagcccaaaggacagcctctgatatcatccggtgtgattcccaatgcatccgtatttttgaaaagagacataacctctttgctgtccagagggatctccctggcattgatgccggtcagatcctccagcatacggatcattgtgggatcatcgtgtcccagtatatccagcttgagcaggttggagtcaatggaatggtaatcaaaatgtgtggtgatgatatcgctgttcatatcattggccggatgctgcacaggtgtaaattcctcaatgtcccagccaatgggaagaacaatgataccaccggggtgctgccctgtggttctgcggacccctgtgcacccctgcacgatcctgttgatctcacagtaccgcttgcggcttccccgctcttcaaagtaattcttcacataaccaaatgccgtcttctccgcaagtgtaccgatggtacccgccttgaaggtctgccctgccccgaaaataacctccacataccggtgggcttttccctggtaatcgcctgagaagttaaggtcaatatcaggctctttatctcccttgaatcccaggaacgtttcaaagggaatgtcaaagccctcttttgtcagcggctttccgcacaccgggcagttcttatccggcatatcgcagccggccctgccggagtaagcccgtacctcctcggaatcaaagtcacagtagtgacaggagggacaataatagtgggggctaagaggatttacctcggtgatacctgacatggtggctgcaaaggaggaacctacggaaccacgggaccctaccagataaccgtcgctgttgctcttccacaccagtttctgagcgatcatatacataaccgcatatccgtttgagataatggagttcagttccctctccagacgctcctcaaccactttcggcagctcctccccatatatctcatgggctttgctataacagatctccctcagcatttcatcggagttttcaatgaccggaggacactttcccttgtggatgggtgatatcttctcaaccatgtccgcgattttatttgggttggtgatgacaacctcctccgccttctcacttcccagataggagaattcatccagcatctcctccgtggtatgcaggtacagcggcggctgcagacccgcgtcgtcaaaaccttttcccgccataatgatccttcggtatacttcgtccgacggatccagaaaatgcacgtcacaggtggccaccaccggcttattgaacatttcccccagcttgacgatcttcctgttgacttcccgcaggtcatcctcattctggatatccgtcctgtcctcatcccggagcatgaaggcattgttgccgatgggctgtatttccaggtaatcataaaagttcaccagtctggcgatctccggctcaggtcttccgtttaagaccgcctgatacaactctccggcctcgcaggcggagcctatcataagcccttcctggtatttcagatacacgctttttggaatcctgggcctcctgtgataatagatcagatgggagtctgacaccagatgataaaggttcactctgcccgtgtcattttttgccaggataatggcatggtaggtgggcattttctgcactgcgtttacagagacagcacccttctcgttaagctcatccagggtatggatatcccgctcctcacacatggtgataaacttctggaaaatctgggccgtacattccgcgtcgtccacagccctgtggtggtgctccagggatacccccactgcttttgcgaccgtatccaatttaaaacggtttagctgcggaagcagaaaacgtgccattcccactgtatccacagaagtgtaatctgtctcgattcccagatccttgcagttcttttcgataaaactcatatcaaattccgcgttgtgggcaaccatgacagcccctttacagaactcggtgaagcggggaaggatcacatctatgctgccggcacctgccaccataccgtcgttgatactggtgagcttctcgatcctgaacggaatgggtatccggggatttacaaattctgaaaaacgccctacaatcttgccgtcctccacccggaccgcgccaatctcaatgatcttatccctgagtgccgaaaatcctgtggtctctatatcgaataccacaaaggttccacgcatggactgtcctttgctgttctgcacaatgcccttcatgtcatccaccagataggcctctacaccgtagatgactttaaaatccgcatccggcggcacaacgccgccccaggagtcaaagcagtggttggcctccgggaacgcctgcactacaccgtggtctgtgatggcaatggccctgtggccccactcataggcacgcttgataatggcctttgcatctgacacgccgtccatatcgctcatcttggtatggcagtgaagctctactcttttttccgggctggtatctgccctggaactggtaaaaggggcaatcttcttgatccccaccacacttccgatagtcagttcactgtcataccggtcaatggtggtcacacctttcagtttcaggaaagctttctccttcacacctgccaggatctcctccacctggtcatttcttgcaaacattttcactgtgatggaatctgtaaaatccgtgacggcaaaaataatgatggtcttctcatttctgatttctctggtctccagggtcatgatctgaccgcggatgcagacctcacccatctctgtctggacactttccagagggatcgtctcatcgtcaaagtccctgccgtagagtacatcaggattgtccgaacgcttgatgctgcgcttgtaatcgccgaaactgcgttctccctttccaaagcttttcctgccctttccgtcctttcctttttcctccttctggccttttggacttttttttctcctctgcaggcgctttaccggcagaagcgtctttcttttcttcttccttcaaagcttccgaagcagtaccggcaccttcctccaaaaactggtccggttcctcctgctgctgcccgaaggaagactgctcgatcacatgggcagcctcctgcataatgcggatttcactgtttttgcggactttgctctcactggcctccacatattccggttccacgatcagagaaaaaggacatcgctcgcagaacaccttctcgatataggatacaagttcctcctctcggctttttgccaacacggaggactgcattctaagctccatcttctgttcctccgggaaggagatctgggcagtgcggaacatattgtacacaagtatactgtagtttttcagctccatagacatggatgtccggtaagcgtcaaaaaacagctttggggtatactgtccggtcagggtgaacttctcaatgatcttcaccgacataggcacaccgggaaaaaactggtttcgtatggtctcttccagggaatagatatattttttatggatccactgtctgctccggatatagatcctgatatggtctttttccggattgacggcaactttagtcaccactacctcttccaacagggcagagagttcccgccctgcctccagatcagggaagacatccagaaaattcttttccatcattaagcttcctttctgtaaaacactagttctcccagttttccagttcctgcctgagaactcccagcagttccgcctccggaacctttctgatcacttctccttttttgatcagcagtcccacacccttaccgcctgcgataccaatgtccgcttcttttgcctctcccgggccgttcaccacacatcccatgacagccactttgatatccagcgggaattcctgcaccatggtttccacctggttcgcaagtcctatcaggtctatctgcgttcttccgcaggttggacaggacaccacctcgatgcctcccctgcgcagacccagtgtctttaagatcctctttgccgacttgatctcctccaccgggtctcctgtgagggatacacggatggtatcaccgattccctggtacaggataatgccaaggcccacagcggatttgatattgccggaatacagggtgcctgcctccgtgatccccacgtgaaggggataggctgtcttttctgccagaagttcatgggctttgacgcacatgagaacatcggaggacttgatactgatgaccatattgtcataatcaaaatcctcaatcatcttcaccttgtcaagagcgctctccacaagcccctccgcagtcacaccgtgatacttctccaccagctctttttccagggagcctgagttgactcccacacggataggaatattcctctcctttgcagtgtccacaacagcctttattttttcgggaccgccgatgtttccaggattgatgcggatcttgtccgctccgttctccatggctgccacagccattttatagtcaaaatgaatgtcagctaccagtggaatgtgaatctgcttcttgatctccctgagtgcctctgccgcctcaatattgggaaccgtacagcggacgatctcacaccccgctgcctccagcgcatggatctgggccactgtggcctttacatcctctgttttcgtgttggtcatggactggatcaggatcgggtttcccccgcctattttcttgtctcctatctgtaccactttggtatggtcacgatacatctcactgcctcctgtataaaaagcgtgttcaggctttttccgacccaaacacgcccgttttcatttaccggttaatctctaaaagcttatttttcagttcgccctccagacggttcatctccacttctgcttccatacgcttctgatgtccctctttctggatgttcatgatctcatcaaatgtgctgatcaaggattcattggtcttcttcagcgtctctatatccacaatgccccgttcagattcctttgcggcttcaatggttgccatcttaagtgtctccgcatttttctgaagaagcgcattggtcatatccgtcacctgtctctgcgctcttgctgcttcggaggaatgagccacacccaatgccagaaccatctggctcttccacagaggaatggtgtttacaagggtagactggatcttctcagccatcagggtgtcattgccctgtaccagacgaatctggggtgctgtctgaatggagatcatacgggtaagctccaggtcatggatcttcttctcaaatctctggcacatggaatccagatccttagccgcctgggcatcctccggaaggccgcttctctgggctttctccataagctgaggcaggtctgtacttctcacttcctgaagttttttctttcctgccagtatatacatggaaagctctttaaaataattcaggttcagcgcatacatcttgtccatggtagccgcgtctttcataagctggatctgatgctgctccagggtctggacgatcttccctatattggtttctgccttggcatattttgtcttcatggcttctattctgttggagcctcttttgaagaaaccgcgcaggcctttttcttcctcggctgcatcaaagctttttaactgtgtgaccacatcgcccagaaggtctcccacttcgccaaggtcctttgtctttaccttttccagtgcctcctcggagaaatccgccatctttttctgagttcccgcaccgtactgcagaatggccgcggagttgcggatatcaatctgctttgaaaaatcatctaccattttccgctccgcatcggagagtacgctctcgtcaagctgcggttccaccggctcctccttttttatttccaccaccggcgcctcctccttgggcgcatcaaatgtcagtgtgggggttactgtaaaatctttgaattcatcgctcatctcttactccttcttttgaaaatctttgccgcctgtaaggccttcctgtgccagcatagtcttcaggactgatatatctgtagatacatcccacgccgtatccctgaaaaaactgtccagaagattctcaaatgcctgattaatagtatccagtgtattttcaatttcttttttcgccgtcttgatattgtcgccttccacgtcctgcttatccagttcctcatatgcctgcaaaagcttcactgtggtgggaagataatagtccatgaatttgtgcaggtcatcgatcagctcaggatgctgctccacgcgcttgaagatccgtcggatcacattctccaggtgatacatcttgttggaaatctcaactcccggaatggcgtcattgcttttacgtatctgttcaatgtaggcattgccctcttctatcaccttgcgggtctctttcgatagatctgcttcgcctgctgtttcctcttctttttggatctcctgttcttttgtcttctgctgtatttccgcctgtttctttgtctccagatattgtttgtaagattcatcactggtgatcaggcaggttcctgtatcatccaggtgtccctccagaaacatatatttcttgatcatccgctttaaatccctgcggacaaacttctccggctttctgactccctttgccagttctgagatctccgcatacgtcctgccattcagggtgtgtatgtaggaacggaaacggttcactttctttctgagcttgtttccgcagattcccataataccgctgaggccgatcgccggaccgaacacggacagacagattcccatcttatccgctacagagccgatgaacagcgagcaaattcccagcacagtcagcgtaacgccgaacatggcgaacagggcaaaacccagggtggtaaaaagaatacccatagctctcggtccactggtgtttatatagagggcgaacttttcccttgcctctttcacacgttttgtctcaggatagcggtatcttggccttgtctgaaatccgcccggagagccgctcccatcattaaaggaggagctgcccgcgtacgtcctgcgggagccgggacctccataggaccttccgttggcgtcctgaccattatagcgggggccctgattcatactgttcttagcctgatccataccgcttttggctgcgtctttcacactgtttgccacattactcagagcgtcctccagtgtggcgcccaaatcccggttcagccggttaaaatttcctgtatccagagcatcctgtacgatatccttgatatccctgcccagattattccaatcattatttgccatttttatctctccagttttgaataaaacgattcgctatttgatatacatgtccgtttgaatacgattatatatgaaataagagaaaaaagcaatgcggcatctcttgcaattcatacgttaaagttctataatgataaaaaattattaatacataccgtatctatcggcagaatggaggaaccactatggaaaagaagaacattgactggtctgaactcggcttttcatacttaaaaaccgactaccgctatgtttcaaattataaggacggcgcctgggatgagggtgcaatggtcacagacgacactgtgactatcaatgaatgcgcaggtgtcctgcagtacgcgcagacggtctttgagggactcaaggcctacacaacggaagacggacgcatcgtcaccttccgccccgacttaaacggtgagcgcatggaaaactctgcccgccgtctggaaatgcctgttttctcaaaggaacgtttcgtacaggctgtgatcgagactgttaaagcaaatgcagcttatgttcccccatatggctcaggggctaccctgtatatccgcccctatatgttcggaagcaacccggtcatcggtgtaaaaccagccgatgaataccagttccgtgtattcaccacccctgttggtccgtatttcaaaggcggtgtaaagcctctgacgatccgtgtcagcgattttgaccgcgctgccccgaatggaaccggccatatcaaagcgggcctgaattacgccatgagccttcacgccattgtggatgcccacagccagggttttgatgaaaatatgtatctggatcccggcaccagaacaaaggtggaagagacaggcggcgccaacttcctgtttatcaccaaagacaacactgtggtaacaccaaaatcccacagcattctgccgtccattaccagacgttccctgatctatgtggcagaacattatctgggactgaaagttgaggagcgggaggttcttctggatgaagtaaaggattttgccgagtgcggactctgcggtacggctgcagtcatctcccctgtgggcaagatcgtagaccacggcagagaaatcctgctgccggcaggcatggaacagatgggtcctgtaacccagaaactgtatgacacactcacaggcattcagatgggaagactggaagctcctgagggatggatccaggttatcgaataaataaattacataaaacagcccccggaagcggatacttccgggggcttatcttatgtctgctgctggtttacatctgctgctgctttatatctaataatctgtttcgactgatctgttccgacggtctgcatatcccgctccgggctgcagatatcacacacaattttttttatatttcacaaactgatattccagatcaaagtatgtctgctcttcactggcctctgccggtgaccagtcctctctctcatccagattggggaaccaggtgtctgcctcataggcaaaatcaatctttgtcacataggccgtgtcacagtgatccagcatggcgctgtaaacgctgtcgcctccgatgacataaacctcttcactgtcatattttttcagttcttccagaagttcctccacactgtgtacgatcacagcatcctttaccttataattcacatcccttgtcagcacaatattggtgcggtttttcaaaggctgtcctccgggaaagctctccagtgtctttctacccatgactaccaccttgcctgtagtggtcgtgcggaaaaatttcatgtccgccggaatgctcacaagcagacggttatccttaccgattccccagttcttatctacagctacgattatattcatcctgtctctcctttgccatacagattctcagactgctatgggtatattcctgatctgcggtcctgcctgataatcctccacgatcagatcttttgttgtaaaatcataaaaatcctttatctccggattcagggataccttgggcgccgcatacggcgttctggaaataagctcctgaacagccggtacatggcggtcatagatatgggcgtctgcgatcacatgcagcagctctcccggtatcatgccattgacctgggccaccatcatgagcaggatggaatactggcacacattccagttatttgccgccaggatatcctgggaacgctggttgagaacgccgtttaaaataagccggtcctcccctgcgtcctttgtcacattgtaagtcatgctgtagcagcaggggtccagcgcgccgctgtgcagatattcaaactgatacagatttgtcatgatcctgcggctgtagggattttcctttaactgctgcagcacataatccatctggtctgtctcctggcctttgtaaatgaatttccttcccaccacgtcgccgtagcaggtcccgatagacccgtcctcatcagcccaggcatcccagatatgggaatttaagtcgtgaatgttgtttgattttttctggtatatccagaggatctcatccatgcagcttttgagagccgtcttccgcagtgtcagcgcaggaaactcttttctcaggtcatagcggttcacaaccccaaaacgtttgatcgtgtaagcgctctcccctgtatcctcccatttcggccgaaccttctcgcccattgtgtctgtgccgttctccagaatatcacggcacatatcaataaaaatatgatctgccagactcatgtcttgtcctcacttttctatgatttttgtaactgtccggtactatcacagttactgctctgctttttctcttttgtcctatacagaatatcattaatcattgaaaatgacaatagcattgaatcgtcaactacactctaagaacggatactgctgttcactccctattcagtaaccaagccgcagcctgatctctgaataagaacggactgatgaccttttttatttaaacagattcatgatccatggattggaagttataaaaatgatcaggatcacgatgggcagtataaacttgatcagcactgaccacacgttgaccagtttaaagctgatcctgccatcattggtgacttccttctccgcatttttgctcttccacacccatccgataaagatacaggccaggattccgccgatagggagagatacatttgacaccagataatctcccagatcaaagaaggtccttcctgcgatcttaatatcactccagattccaaagctgagcgcgcagggaattcccagacaggtgatcagcgcggcagagataacagatgcctttgcgcggctcaccttgaatgtattcacggcaaaagaaaccactacctccaaaaacgcaatacttgtggaaatggccgcaaacagtaccagcacaaagaacacaactccgaaaatctttccgcctgtcatctcatcaaatactgccggaagagtctggaacataaggctcgggccgctctccggtgaaaatccgaatgcaaacactgccggaagaatggcaaatccggctatcatagccactatggtatcaaaaaacgcaatacttgccgcactcttggggatattctgatctttgcccagatatgctccgtatgtaatggtggctcctgtgcccagtgacaaggagaagaatacctgtccaagtgctgacagaaaaactcccggtgtcagttttgaaaagtctggtttcaggaaaaatctgatgccttcccctgctcccggaagggtacaggaacggatcacaatgacgatcagacagacgatgagaaggggcatcatgaccttgcaggatttctcaattcccttctggatacccatcacaacaattgccacagttatgatcataaacaccagataatagatgatctggctgcctgtgctgctggtaaaggatacaaaaaactcttcactgctcttcggcagtcctgtaacggaaacaaagatataccgcagaacccagccgcccaaaacagcgtaataggatagtccgataaaacttgtgataacagcaagtatacccacgccgccccacttggagttcagggccttatagcttccgaaggcgtccttccctccggcgcggccgatactgatctccgcaatgatcagcggaatacccaccagaaaaatgcagatgaggtataccagaacaaaggcaccgcctccgctctcccccacaagcattgggaaccgccataagtttcccattcccacggcagaacctgctgctgccataataaatccgaagctccccgaccatttgggtgcccctcctgtttcctgtgtctgtttactcataatctcctccttttccggcaatcaaaagataacaaagcgtcaaaaaaagctcccgtccataattgtaataacaatcaggacgagagcattaagcttcgcggtaccaccttgattcatccgcatctcacggtgcagacctttgcaagtacagaagatccgaaccactccgtgaatccccttatactccggcgctgtaatgggcgctcccatcgtagcctatacttctgtagtcggtacgcggctccaagaccatcttccactcagcctgctgcacttcctctcaccaaccgaagctctctttgccagtctgcagaatgtactcttcttttctctgcctttttctttttattttaataataagtataaggctgttctttttccttgtcaaactgtttttccgcaaatttgttactgttcagcctttgggcttcatagcagcaaaaacatgcacacagactgcaaaaaacgcagcctctttacactgctcccaaaacgtgatatagtcaccaggaagtaaactataatccacagaatcaaaagaggaaccaaacatgaagaaattttttatactgctgctgaagcccttttcttttctcccggccctcctggtgatgtatctgatattttctttttccagccagacgggagtcgaatccggcaatctcagctataaaataagccataagatcattgtaaccgcagataaaatactggacaaaaacatgagtgaagaacagattgcccactatacagacaagatccacaccccggtcaggaagctggcgcacatgagtgaatacttcgtgctggccgtctgcgtgtctttccctctgtatgtatacggactgcgcggaatcttgctcattctctttgcagggctgatcagtgtgggctttgcctgcacagatgaattccatcagtcctttgtagcgggccgcggcccctcaaaaagggatgtgatgatagacagcatcggcgcctttgccggaatcctgctggtacagtttgtctgctggaatacccttcgcagaagcagaagaaataaccggcgcagacgcgccaatagctagagcgcgcctgagagttcatcccgacactctagtgcagattcagggagacatccccgcagggaagcacttcctcctctccctcctcatttctcaccagaagtctgccatccggcaggattttctttgcctccacacttcttatctgtgtcccgtacgctacctgcacacgtcttccgggcactatatttcttgtgatatactcctttggaatcccctcttttcccgcctcctcaagcagataattgataatatccgcggttagcagattcctgtccacatatactccatcctcaagtatggctccggcagcatctgaaagctccttgggaaaaccgccctccggtatcctgaggttcaggccgattcccaccaccacaagttcgatatctccggtctcaaagtccgtgacagcctctgtcagaatcccgcagaccttcctctctccaagatacagatcattgacccacttaatccccaaagataccccgcagacctcttccacggcacgacagacagccactgccgccgctgccgtcagcgtcagactctcctgcgcagtcctctttgggcgcaggagcacacttagataaaggccgctgcccgccggtgagtagaaactgcgcccacgcctgccttttccctctgtctgggcttctgccgccacaaaagaaccgtggggaagattctcctcgatccctctttttttcagatactggttggtggaattgatctccttttccacctccatgaacacatccctgttatccagatgcattttcactgcctccacagacaaaatatcattgtccgtctcaagggcatagcctctgttattcacagccgtgatccggtatccctcctgacggaggctcttcatagctttccacaccgctgttctggaatatccaagccttaacgccagctcctctccggacaggtattcccccctgtggctctccagcagctttagcagctctgattttgttgacatattcctgcctcccatccactgatctttctatatttgtctgcatttacgaaaagccaggctcccgcccgggaatctggcttttctttcgtatatccgctatctctcttcacggaagtaattcacaccgcaggactggggctgcgaattctcttttgaggaacggatggatgtgacgatcagcacaagtatcgtcataaagaacggcaccatatcgaaaatggaatccggtatcctgatgaccgactttggcacataatacttcagtacactgaacgcgccgaatactaaagccgcaaagacagccttgttgggattccaggtggcaaagatgaccagtgccacggcgatccatcccaggccgtttacacagttgctgatccatacgccgttacagatgatcatggaacagtatgcaccgcccagaccgcagattcctccgcccagcatcagattcagatatttcagtcttgtgacaggaagccccgccgcgtccgcagccgccgggttctcccccaccgcacggatgttaaggcccgcctttgtcctgtgcaggtaaatgccgcacagtatggccgccacgatcccaagatagacgaaaatgttatagttaaaaaagagttttcccagtaccggaatatcggacagcacagggatctccactttgccgaggctttttaaaatgccggctggcagctttaaagaggtttcccctgacttctccctgaaaaagtcaccgaagaagttgctaagtcctatcccaaaaatggtaagtgtcagacccgtaacgttctggtccgccataaaagtaaccgtgagcacagcataaataagggcacccagcatacctgctgcaaacgctgcgatcagagcaagcagcagattgtctgtcttatatcccatgataaaccctgcacaggcgccgatggacatcatgccttccacacccagattcagatggcctgacttctcattgatgatctcgcctaagatcccgaacaaaagcggagtaccggcaagaactgccgccacaaaaaagttagtaaaaaaatccattacgcctttcctcccttcctgcgggttacaaaacggtatctgacaaagaattcacatcccagtacaaaaaacagaatgataccctgaagcacatccgcggagtacgcggacagcccataggaggactgcatgaccgtacttcccttttccaatacactgaacaggaaagataccaccaggatacccacagggttaagctgtgccagccatgccacgataatagccgtgaatcccacgccgccggccacggatgtggtcagcgtcagatcagaaccgctggcctgcaccataccagcgataccgcagatggcacctgaaaatgccatggtgcgcagtacgatcttcttataattcatacctgcatactgggctgtggcacggctctcgcctactacgctgatctcatatccctgttttgtgtatttcaaatagatatacacgatcactaccagaacaagtccgatcagccatcccacatgcacgccgaacagcttgtcaagctgcgcgttctctccaaaacgggcaatcttaggaaatcccgaggaatttgggtcctgccacggaccatccctcaaaaaggagatgagatacagcgcaatatagttcagcatcagtgtaaaaagcgtctcatttgtaccgaatttcgctttgaagaaagcggggatgataccccaaagcgcaccacccagcatacctgccagaaacatgcagatcatcagaagccaatggggaaaatcccagcagaacagggcaaaaaatgtggcaaacacagcgcccatgatgatctgcccctcggctccgatgttccagaaacgcatcttaaatgcaagggtaagtcccagtgccggtatgagcagcggcaccatcagcttaatagtggcctggaacgccatgctgcttctgaacgcgcccgacacgatcgtagcatacacggaaaacggattatatccgatacagaggataaagaggccgccggccacaatggcaagcactacagaagccagacgcagcagtctcacctgctttgcggggcgctcttttctcttctcaatacgaatcagaggttcttttttttcttgtctcatccatcagccttcaccccttcccttttagatccggtcatcatcagtcccagttcttcctttgttgtcacagaagcatccacaatacctgtcacctctccatggcagagcaccatgatcctgtcagagatttccagaagcacatccaggtcctcaccgataaacataacggcaacaccttttttcttctgctcattgagcagatcgtaaatggtgtaagaagaattgatatccagccccctgaccgggtaagccgtgatcagaacagacggctctgactcaatctctcttcccagcagaaccttctgcacattaccgcctgagagcaggcgtacaggagtctccacattaggcgtcatgatctccagccgttccaccagctcttcagccagttttttagcgggctttctgtccacaaaaataccttttgccttgtcataggatttcagcagcatgttgtctaccatgcccatagaagccacaaggcccatgcccagcctgtcctctggcacaaagcccagactgatgcccaggtcattgatctgcttcggagtcttgccgattatattctctttattgtgcagaacagcgccggtctccacaggcacaagtcctgcaatagcttcgcacagctccttctgcccgctgcccgcgatacctgccacacccaggatctctcctgcctttatctcaaaagacaaatctttcagggcagtagttccgtctgctttttttacagacaagtccactaccttcagtctggtgtgtacattctcgcattttggccggtctatctccagagtgaccggacggccgaccatcagctcagtaagctgtttttcattggtctctgctgtatttaccgtatcaatactcctgccttttctcaggatcgtcacccggtcactgatctccattacctcgttcagcttgtgggtgataatgataatagcgcttccctgctctttcattctgcgcagaatggcaaaaagcttctgggtctcctggggcgtaagcactgctgtaggctcatccaggatcaatatgtcagcatttctgtacagcaccttcaaaatttccacggtctgcttttcactgacggacatattatagatctttttctcaggttctacctcaagaccaaacttcttggtcagctccagtatcttttccttcagttcctttggtttgatcctctttccctctgcaccgatcaccacattatccatggctgaaaacacatccaccagtttaaaatgctgatggatcatgccgattcccagtcttttggcatccatgggcgaattgatcaccacttccctgccatttacatggatacttccctcatccgggtgataaatgcctgagatcatattcatcaatgtggtttttccggaaccgttctcacccagaagcgccaggatttcccctcttctgacatccaggtcaatatggtcgttcgccacaacgctgccaaatgtcttcgtgatacctctcagctcaatggcattttctaccttgtctaaagccaactgtgtcacctctcgtttctttctgttttggtaacgcatacaccatccgttacaattttagacacaaacatacagggtaattgtaacataagaaaagagggaatacaaaacgattttttacattttgtattccctctttgtttttttctctaaacaaaacttaatgactgcatatgcgcagttagatgcaaaattatgttactattaatccacgatcacgttcttgtaataccagttgattcctccggtaatagttgcatcatccagtgtgccgccttctgttccaacaacttttccgtcgtttgtctccagaacaccgtcaaatacgttgaagccatcttccatgatctttcttctggcttcttccactttttctttggttccgggtgcgcacagttcctcgttgaccggagtgatgtccaccagaccgtcatccataccgccgaagtagatctcaggtgtccatgttccgtcaatcaccttctgaactgcctgtgtataatatacaccccagttccagataacagaggtaagagttgctgccggagcgtccttgctcatatcagagttgtaaccaacgccccatacgcctgcagattctgcttctgtctgtgggttcggcgtatcacagtgctgtccgatcacgtcacagccctgagagatcagagcttttgccgcatttgtctcttcattcgggttaaaccagctgtttgtaacttttacatggatctccgcatccgggtttacctctgcaacaccgatggcaaacgcgtcgataccgccggtaacctcagagttctcagaacccatagcggcaacatatccgatcttgttgctctttgttttaaggcctgccgcgataccgcttaaatatcttgcctgataaattcttccgaaatagttgttaaagttggaatcattcttcttatatccggttccgtgagagaatatcacatccgggaattcctctgcaagctgctcacaggtgtccatgtagttaaagctggttgcgaaaatgatctgacatccgtcctcgatacattctctgatagcctgctctgttttggtggggtctgtatccgggatattgttcttgcggatgatctggctgtcttccagtcccagttccttctgcatctcaacgattccctggtcatgtgtataagtgtatccggaaccttctgccgggtcagtgatatggataacaccaaccttcaggtcttcctttgccaccggtgcaaactttccgctgccctctgtcttgctttcatcagcaggctcttccttcttgtccgcatcgtctgctttttcggtatcatccgtcttcgtatcttccgtcttggtctcttctttcttgtcttcagctccctgctgctgtccgcagcctgccagcattgcaccgaccattgtgagagataacacgatacctaaaattttctttttcatgctcgtcctccttttgataattcctgtactatttttctatttacgagtacaaatcaactataacattatattttttgtttttcaacctgcatattaaagatattgtctcatttttagcaacagttgagcctgcctgaactgttactcatttttctagatattgataaatattttgatatactgtcaacttatctttttcgttcaatatttcatggcgcattcccggatagagctttcctgtcacatggcggtagcccacctgcctcatgtgctgaagctctttcacaaactttcttccgttgccgatacaggggtcatccgcgcctcccaggaacagtatgggcagttctggattctgcagcctccatccttccttactgtacgtctccctaagcagcattaaaagtccttcaaagccgtctgctgtaaaggtaaagccgcaaagaggcgactgctcatactctttcaccacttcctcatcggaacatatccaggcaaaccggctcttctcccccgcaaatcggctggcaaaggagccaaaagacatggcctccagcagcttgctgggatacaggccgcctttgtgctttttctgcgtttttgcaatgaacagtcccacattcaccgccggattctcgcagggcggcccggtgaggatcagcttttccagttcattgtcaaaatatttcagatagttcctggccaccagcgaacccatactgtgtcccagaagatacaccggcagatccggaaacatttccttggaccataaggtcacctgatgaagatcctccaccatggctttattactgcctccgtagagatatcccagttcattctggctgtgcacactctttccgtgaccccgatggtcgtggataacgcagatatatccgcgttttgccagatattccataaacggcagataccgctccttattctcactcataccgtgggatatctgtactacacccctgcttccctccccgggcactacccacaaaacagacagccccaatccatcgtattctgatttcaataccgctgtgccgtgtaccataataaaaacccccttttcaggcaacagaacccggtcctgctgcagatctcccattatttttatacgcaaaaggccgccgcacactccctgcggcagccctgttacatatgcttagccttctacaacttccagtacatccattggacatgctttcgcacagataccgcaggcgatacatttactgcttgtaggtgagtcctctgcctttaccattacatggaaaggacatgcctcaacacatttgccgcagccggtacattttttcttgctgatcatgtaaacgccttttgcattctgtgtgatcgcgccctccggacaggcctccgcgcattttccgcactgtacacagaccattggttttgcatcgccctttttgtcaatgatctggatacaggatttgtctgggtcaaactccttgtaaaagcttgttgaacaggctcttacacattccagacatgccatacactttgcgccttttgtcactttcagtttcttcatcttgaattcctccgctattttcctgaaattttcgtatgcatcagaagcatacacaagcatatgctcatgtgataattttaacattatatattatgtttcacaagtggattttacaaaaaaggacattttcagccctgcgaaaatgtcctttttgtcgtattttatcagaggattttcctcttcttaaaatcggtttcgttattttgccgcttcgttatagatcagcgccatcatctcaaaatcctcgtccgtgttattctccatactgtgactctgtcccggttcaatgacacagacatcgccgggatgtacttctgtacggctgccgtcattgtccacaaaaacccctgtgcccttcagcacataatacggctccgtattgcccacatgctgatgcataccgatggagctgtgaggctttataaccaccttggcatatagcttgccatgtccgtaaagctcttcctccttcaggatatggtggaattccacggtgccttctccgcctcgtaccttctgctgtaccactacatttgtctttctgaccatgatgtcgatcccctttcttctgtcgtatcccatctgtccccggcagtcagggactctctttcttataagaatgatctgatgataaagaacactgcgggaaccagaaatgcaggaagcatgttcatagttctgaaattcttgattcccagaatgctgagtcctgagctgaagatcaggatacctccgataatagagatttctgccatgatcgccggactcatgaccccggccagcagcagtgccaggcagtagaaaaatccctgccagaaaaataaaacaatggctgcaagtgcaatgccgaatccgaatgtggatgccagcacagaagatgtgacaaaatccagcatggcattggtgaacagatacgtatgatcccccttcagggcactctccataggtcccagaatagacagggtacccacacaaaacagcaggatcgccgtggataagccctgagccaggttcccgttggaaaacccggtgacaaacttcttaaacctgtcctccagatgtatcttttctcccagaagcccgccaatagccagactcacaataaacagaaccgggtacttactctgaggcatgtatttgactatggcgttgatccccagtgcagttgctgccaggcccatagcctgcatcatgatctcctgatgttcttccctgatcccctttttcagtctgctgccaataaagcttccggtcaaaatcgcagcgcagtttaccagtgttcctatcatctcttgtatccgcctttacagtttcaagtattgttccacattcacgataaatactgtggcgccgcccacatcaatggtgaccggcggtgcggaatatcccagcaccggaccttttgttccggccgaataggtggggttgatgagcatctcttttcttctggaacactcttccttgatgacctggagcaccatctctactttgtcatcctcagttcctatcatcagcgtggcatttccttttctcaaaaatccgcctgtactggcaagctttgtcacactgatgcgttccttattcagacgttctaccacgaatccttcatcctctttgtgcacgatcgcaaaaatcattttcataatgaagcacctcctaatgcagtgctgctctctgcccgccgcccggcctctcctgaaaccccaggcgcctgtgagcgtctgaccagcttttcgtttattatagcataaattgggcttaatggaaaattattttgcataatttttcttgtaatttctgttaataggatgcaaatatcactacaatatcaagggctgtacggcaggaaagcattctgtacgcgtaaaaatccccttttcacaaaacattcaaattccattcacaattcttttaatatttcaccacagtttcatcacatttgtgctttattattaaatacatagaaaggcaatcacctttatataaaaattttctttttcatacgccgggctttttaaaagcccggccctcctttttttaaggaaaggaactatttttcctttaagatttctatcagatcctgcaccgcattgggtacataatgctttttacgataaatagccgcaatcttccggggcggcggagcctgtaccagccggtaacactgcagtcctctctgattatctccatactccgcaatactggacaataaaagggtaacacccactcccgcttccaccaaatctctgcatacatcaaagcttccgcattcaatcgtcttccgaggacgaaagcctgcctcccagcacaagtcaaaggtaatatcgtacattccgtttccttcatttacagtcagaaagagcatatcccggaattctgctatatccacagcagcgtagggagaattgccatcgggctcacttaaaatagtgagatgctgattgacaggatgctctctaggtaccgccaacagaatttcttcctccatgatttcctcaaccacatatttcacatcatcaaagggagctgtggcaatacacagatccatatcaccgttatccaggcttttcatcatctgataataaggatattcccgtagaacaatggaataattgggatacttttcaagcagccgcggtattcggcctgccagcacacagcggcttcggtgaggcgctgccccaatgatcagccgtccatactgattgttctgcatatcattaaaacatttttccgtctgcgcctccatatccaggatgcggcgggccatttccacatacagctctcctgccacagtcagtcgaagaggtgttgtagtccggtcaaacagtgtatgtcccagttcattttccagtttgctgatatattggctcagagatggctgagcaatgataaggcgtttggctgccttggtaaaatttttttcttctgccagggtgaccacatactgcaactgtctgctattcatagatttcccctctgcatttctcttttttcttaattataacaaaggaaatacatttggtctatccaattccgcttttccctcttcacacttcaggacgggaacatttaaaatattgctgcccgtatctgaggatctcctcatcccaaatcatcttccgcttgggatgagcagcaaactggcaggaaataactgttcctggtccatgaaacatctgatcagcggtctttcgcacatgctccctgatctgttccggtcctgtgccctccagatccataaactgtgtatcacatacgcctcctatcatggccagttttccaccgaactttgtcttgcaggatgcagggtcattggaaatatggacggttgcccaggaactggcccccatgtctgcaatctcttctgctatgggagccataatgccgcagcaatgatgctcatacataactccctgggaagttatgttgtcaatgacacgctgaagatgcggcttgattaaactcctccagatttccggagacataaacataccgctgccggagccatagtcatcatgcatattaatgatatcaggtttatagtaacggatataacagttatgaagacggattttgtgatctgccattgcagagaaaaatgcttcacaggcatccggttcttccagcagagcgcagagggcatctgtaaagggcataatgctgaacatacgctcccacagccccagccgatccacaattttgcagagtttttgttcacggttccagccggcagtgtcggcggcagcatgggcgttccagtccaatcgattcaaatccgggaattctaacatatcctcccaccttgtgatatcatccagaagatgacagcccggtgcagggttggatgcctttattgtcggttcaaactgccatttttgtccaaaccagtcctcattgatcaattctgtcaaaccaccgtcaggcacttcgttgacaaaatccaggcccataggcttgcagatatccacgtcttccatcaagggcatgaattcaggctcttgatgatggtagaccaacagcatattttccttaaatgtaacagccatggtatttcctcctttcctgcagaccgccctcctattcagactgtctgcattggttttccctgcttattcaggccgtctgtatttaaaatactgctgaccgtatgaaagcagctcatcctggaatatctgattccgctcaggatggcagatacagcccacagccataacggttcccacccccggaagcattttatcggacatttcccttacatgggaacgcatctgttcttctgtggtggaatccatatcaaacagctgtccgtcacagacaccgcccacaaaagccagcttatgtccaagcttctgtttacaggcacatacgtcattgaccacatggaccatattccaggaactggcacccatatctgctatctcctgggcaagaggagccatataaccgcagcaatgatgttcatataaaactccctgggaagtaatattgtcaatgacccgctgcagatgtggttttatcagctcccgccaagtatccggggacataaacagtccgtttccgtgcccgtaatcatcgtgcatacagatcacatcgggatggtaatatttgatgtattggttatgaagttttattttgtggtcagcaactgttcggaacaaatcttcgcaggcctcaggctccagcaaaagtccgcagagaagttcatcaatgggaaccatggaaaaggcccgctcccacagaccagtagcatctttgatctccagaagcctgtttttgtcaatttcaacagcatcctcatcaaattttgctttccagtctattgaatccacatcaggaatctccacataatcccgccagtcagcaatatccgcaacaatatagtgggatgcatccggattaaacgcattcaccataggttcatagacccagtcctgaccaaaccagtccgtttctttcttccctgccctttttccatggaaaagtacattcttaaaaccgggttctacacttcggatcctctggatatcacccagtaaaggcaaatattccggtatcttgtgctgatagaccagcagcatattctcacgcaaagtaagcatagacgtttcctcctttttactttgtacaggctgtgttttcatttctgtctttatcataactcaatctaaaaatagccgccaatacataattttttatcaaaatcatagtattttacctataatgttgaatctgagataccggcagcataaacttgcagtcaaaaaaatattataggcaaaacacaataaaaaatatagaattttatgtatttgaagcaataaccatgtgtgtgctatgatgaaattgtaaaaacgaagccgtgaaattaagaaaggagtgttggggttatgctgcagatcttgtttacactgattcttctggcaattgtaatttatggcattgtcaaaaaaatcaacattgcaactgttttgctgtttgcgacaatcattggatatctctgtctgactattgcagggggaaccagtgtggcgggagaggaatccatcggaaaccgctttctggatattttcgagataatcaacagttctatggtaaaagccatgaccggaaatatcctgacagctatggttatgatttcctatatggattacatgaaagagctgaaggctacggatatgtttgccactatattagctgcaccagtgcagaaatggaaatccaaataccttgttgccgcctttacaattccaatcggtgtgctcatgggaattgcaatttctggcggttcctttattacaatgaccctgctgctcggaacgatctatccggtattaagagcgcttggatgctccaaacccacatgtgctacggccattctgctgcataccgtagtcctgatcagccctgccagggcagcctattacaatgcattgagtctcatggaaatggaggcatccgttccgctttggtttgtccagatccagcttcctgtggcagctgtaatggtcattgtcatgatgatcttatttgttattaccagtaaatattttgataaaaaagaagggcggactgaagaggccagggatgagaccttgaaacttaccacgattcgggatatcgacgccccggtcatctatgggatcctgcctctgctgcctttgatattagtggttatcttcagtgaactggtagttaaatctgtagtcatcagtgttgttgcagcctgtatcctgtcctggatcatttcttttatcgttaaccttattgctacacgtaatctcatggacagtctcaaaaggtttaattccatttacaaagggatgggcactgtaatgacaaccacaggtcctattctgatgtttggaaccacctttgcaggtgttatctctgccgttggaggaatgtcgatcctgatcgacagtgtctcccgtgtcgcaagcggagaagttcttctggcactggttggccttacgggactggtcatggtagcactgaccggtacctttaacggcaatcttgcactggtttttcccattgtaaaagagattgtagcctcaacgggaatcggagcgctgggggcagcacagggtgttatgcttaccctgacagccggcggaggtctctgcccggtatccggacagaatctgttcctggcacagcagacagatacggacatcctggttattctaaaacgtggtgctattcccattatctgcggtgctgctgcacaattccttgtaagtgttctgatattcggttaaaatataatcacaatcaagaaataccaagttatccccagacggcagggaaatatctccctggcggctggggtatattggcataaagagagttccggtgtaaacgtgcatatacaaggggggtgtctgcagtgtttcaaatcgtatttacattgcttctgcttgccatgatcgtctatggaattatgaaaaagatcaacatcactactgtactgatgtttgctacagtatgtggatatataggtcttctgctgctgcagaaagaatacgctgccggtgatactacaagcggcagccactttttagatatctttgaatccattgggaattccatgaaaaattctatgggcgggtatatcctcacatccatatccatgctctcctacgtggattacatgaatcgtatcaaggctacggatatgtttgccgcgctccttgcagcaccggtacaaaaattaaagtataaatatctgattgcagccttcacgatccccattggcgttttgatgggaattgcaatttccggctccctgatcaccatcacgctgctgctgggcacgatttatcctgtgctccgctctctgggctgttctaaacccacctgtgccactgctatcctgctccacaccattatcgccataagccctgttcgttcggcttattataatgccctgagtctgatgaatatggatatctccgtggccatgtggttcatccgtgtgcagcttcctgtggggggtatcatggttgcggtggttatggtactgttcattcttacaagccggtactttgaccggaaagaaggcctgaataaagaagagaaggaaagtctgaagattaaaacagtcagagatatcggtgttccggtatactatgcaatactgcccctgcttccccttatacttgtagtgatcttcagcgaattggtggtcggaactgtaattatcagtgttgtcggagcctgtgtactgtcatggtgtattgcttttacagttcagatgctaagcacacgcagtctttcctcctgcctgaagaattttgaggcaatttacgaaggtatgggggttgtgatgaccacttcaggccccatcgttattttcggtacaacattttcaggcgttctcactgcactcggcggaatgtccctcttcattgatactgtatccaaagttgccagcggctatgtccttctgggtgttgtgggtgtcacagggctgctcatggtatctataacaggaacatttaacggcaatctggcgctggtctttccagtagtcagaggtatcgtgcagggaacaggtatcaatcccctgggagcagcccaggcggccatgttctcgcttacttccggggcaggtatctgcctggtatcaggccagaatctgtttttggcccaacagacagatacaaatatacttgtcattattaaaagaagtctgattcccactataggaggcttcattgcaagttttcttgcaagtgttatactctttggatagtgaaaaaggatacggctgaacggacctacattgttttccgtatctctttttcctgtctactgataaataaaataaccttgaatttttttaaatttttggtgagttgaaaaagtaacttccactttgtaggagtaagttccacctagagtatcttaggtgggatttatttttacaaataaagtgaaatgtgctgtccataggcgcgttttactgatataatcaagataaaacagcaggattttgatgtttttgcgcatacgaatcagaagtcgaatttacgtgtcttgttcggaagttgtaaattccacccctggggagagaactatgatgactgtgcgcgatcacaaactcctggctgtttttttatttattgttgtttaaaatctggggtgtcaggatgatctcgtctgccgggatcctttttaagtcaaaaacatctaatatcttctgcccatactgaaatgcaaaaacatcgtaagggcttttgtttccaagatttggtcttgtataggaattgatgtggctcatcatgaggcttatctgttcctgcgtatattgaccgatatcgatacctttgggaatacagcggcgtatcatttcatggttgttctcgcagctgcctttctgggaagggacgcctggatcacagtagaagacacgggtcctttgattcccttgcctgtcgtattcgatggccgcagggtttgtaaattcaccgccattgtctgtcagcagcactgggaacagattccgaaagatatcagggcggagctccaggtacagtttttcaaatatgtcaatgacagaccgggaatcattcgctgcgcgtaagaaggcgatctggagttcctgctgtacaaagtgtattgtaagaaggacagctccgccctttatgccttccacagaatcgagctgtatcacaggataatgcgggttttcagccataaaagcctgatagtcttcaaaggtgcgtccgacccggcatgctttatctaccttgaagggatgcgctttccctttcctgggacgcatccggacggtccttggcatatccaggttccgggctgaaaagagaccatggttgacataggtatataaggttctttcagacatcatgatctcatccccgtgatggaccgcgatatgatgaagggattgtccactacgcagaaggggagaaatgatgttgtcaagatggagaagttctttttcggagactgcaaagccggaacgggattccgaccttaagaaatcgtattctttttgtgcatgtgcagcacgatagaaagacttttccaaagagcatcgtgaacgttccttacaggagttacaaacataaggaggcttttgcagcagtctacagggataagggacataagaaggacaatactgcatacatgtcccacaggaccagcatggcctgttggacctggcagtacaagcagggcaaagagagtgtatcctgcatttgcggctggcatttatcaggcagtcgttaaaggctctgcccatagcgcctgtcttttctttgtgtatatgtttacgtacctctttggagatggtagtacagtctttatccagaagagaggcgatctgtttaaaggccgtacccttgtcaagctctccttggatcgtgatcctgtcatctaaagtcatatgtttatttttactcatgaaaatatcctccgttggatgaagccaggagaaggagtcatatttgtaagaacaggataccagaaatttcggaaagattaaattccatggccagatgaatggggttaggaaagagtaaattccactcctgaatggaatttactttttcaattgagatttttaaatttttttcaaaaaatgtgttgacatttggcgaaaggtatagtatattatgtcttgtcgttaagacatgcgcgagtggctcagttggtggagcgcgaccttgccaaggtcgaggccgcgggttcgagtcccgtctcgcgctcttttattttatcagaaggacggacatctgtaaaagatgtccgtccttttttcgtcctgtttttatctaggaatatatactcccggcttttctcacaagctcttccagaagggcctgcatttttcccgtaacgggatgttgtcccagtccgtatctttccgccaaacgccccattctgggaaatgccagccacgtactgcccgtttcatcttcccaaatggaaatcctcagcggaagctccagggaaatactctggtcttcctgcatcagctcagttcctacttttggagctccaaatacaaccaccgttgtgggccgcagagtcaggcctgcctcctttgcattttttgcatggtcaaatttggcaaataccggaatcttcttctctctcaaaatatcttccagccttctgaccatatcctccaccggaaactgcccttcaaagagatacaagttattgtcatcgtaattggtagacagcagatctccaaaagcgcctgcgatccttcttgccagattagtaaaatctattccctctttatttgcaagcagtgtgacacataccagctcatctgaatgggtgaacctgctaaggaaagaggaataaccgggaacagaccccttgatgtccatcaaccctctgtgcttataaaactgccatcctgccactcccggcacttctcttccatccggcagattccatggtgcatagataagttttctgtcttttgcttcatggataagcactccgcccgccagtccgatgtcccagaaggaaatgtcctgggcggatgcccagatgtcgccgactcctctgagtgcagaggatactgccggttttattctccggttctccctgtcatagcttgccgcgggttctgtagggtctatgtatttgccgttatttttaaaaagctgatggatattcccagtcagagatacctcctcgtactggagctttttcaaatcctcagcaaacccggttctcccaagtccaagaaactggatctgtctctcggttacaaaatcatgatacgattccccgcttatgcgttctacaatctctgtcagcatcaaaaaattggacgcgctccattccacatctgttcccggaacaaaatgaagcttctctttatctatcagttcaaggatttctctgaattcccattctctgtaaatatcaaagccttcatacagataatccggtatccctgatccatggcggagaagctgcaggatttcaatgccgtaccattcttccggaacttcggggatgtgatcgcccagcctgtcctccaacctcaattttccgtcctcaaacaactgcataaccgccactgcagcaaatgcctgggaaatagggccggtcggccacatggtattggcagaggccagccttctctcaccccgatcagataatccataacccacaactcttggaatatacggtgcctgaacgatcgccaaggtaaggccgggtattcctttttccttcataaattcccatatcatcgaatccacactctgaccaagatatgatacatctgcactgcctctcattttcatgacttcatgttcttttgtattcataatactccttccctgcctgccaggcatagtatggctgcttacttttgccttctgtaacatttttgattacattttatactgtaacaatatcagttaccgttttatttgtcaagatatattttagattgaccgtaattttttcacatattataataaaagaaattactttcggaaaaagagggatagtcatgctgaacataaaagaaataaaatgtcttgtagaaaatcacagaactgaacttatccgggctgctgaccgcatctgggattttgctgaggaacgctttacagaatttcaatcaagcaaactacagatggatgtgctgaaaagccatggattcacggtcacaactccctgtgcagccctgcccactgcctttcaggctcaatatgggaacggacatcccgtcatcggtttgctgggtgaatacgatgctctccccggccttttctggccggctgacagcacaagttccgcccccgccaaatgccagacagatgtccaaaaatgcggccacggatgcggtcataatctattgggtataggagcactaggtgctgctctggccgcaaaagactatatggagaagaaacaactcaaagggagcatcatttattatggctgtccggctgaggaaaacgctgcgggcaaggctcttatgatagatgccggtttctttagcggaacagatatctgcctttcctggcatcctaactacaaaacagggatttttaacaattcccttgccaactgccgtgtctcttactgttttcacgggacaagcgctcacgctgcccagtcgccccatatgggaagaagtgctctggatgcctgcgaactgatgagcgtaggagtcaactatctccgtgaacatatgatagatgaagcccgtatccactttgcctacctaaatgccggaggaaccgcgccaaacatcatcccggcagaagccgaagttttttacgcaatacgcgctccccgcactgaccaggcggaagaattgaaagaacgggtaaacaatattgcgagaggcgctgcccttatgactgagaccaccctggaaattgatgaaaaatgcatctatgaaagttttctccccaatcaggtgctggacagtctggtgctgaaatatctgaactgctttactcctctttcttataccgaagaagaaaaggcctatgcggcacgctttgtcccatacggtgatttaccaaatgcgcaggaatccattgatgcctctcctgatctttctctttacagaaaaacaagcatatctacagatgcgggaaatgtcagccagagaatcccctcctccgcattcatggtaaactgttatgccaacggctctcctctccaccactggagcgtcaccgcgcagggcaaatcttctcttgcccacaaagggatgctggcggctgccggtattcttgcggcggctgcctgtgaaattttcctgactccatctattgcagagcaggcctggaaagaaaaaggacgtgactcttgatcacgtccttaagattgcactcaatatatactggctgttggggaaattcttatgtgtgatgtcctcgagccggatcaaatccacatccagccataattcttcagccacgatcataaggtgagaaaacatgataccaaaattaaactcctcatatctgcccagatggttcatattatgcttcttggcaaacacgtgaattctgttatcatagaccacaaagcgccacggctggctgttcatactggaaggagccaggcgcgcggaatcaagaagctgcttcatccactgtctcggaacttccttgtacacacaaaggtcctgcagatccatgcgcttcgcctccactgcttttctggtatggctgcctctgctgtatccaaaagccatcaggatcacgaatttcagattccctttgtgcggattccctgcctttggctttacaccgctcaaaaaacaagttcccaggccttttgcacacataaagagcgcaagctgctccataatataaccggcattcatcatagcgcggtccttctcttcagagtaaaaggcaatataataaggcgcccttacccccagcagatgtattcttttattttgtcccttagtattatctataatagaaatctccgtatggataccgggattcaacccttcaatctggctgtaatactctctgatctcgttaagcagggcagcctttaccggttccatttcataatttcggactgatttccttgaaaatatcgcttcgtataagttcatactctcaccttttaatttttccgtaacaatattgtaacatataattggggaattgcaatgcctaaatagagggtttttcaaattcttttgtattttttttaaaacctattgacaatgtactccaatacgcgtattattgtattaagcaattagtacagtaatacaggaggtgttacattatatgtcgtggaaacttaatcccgatcggcctgtctatatgcagctgattgagcgtatcacaacagatatcatcgctggtatctatccgccgggaagcaaactgccgtcagtacgggatctggcacagacagcaggcgtcaatcccaatacaatgcagaaagctctttcagagatggagcggaccaatctggtctacagccagagaaccagcgtaaccgccaaataatgatgcggtcagatataaaattaccccagccctttgcgagttggagtaattcactataattcacatgcgatttttgatagattggagtttttcactccagggtgcaagctctgcgagctgggcatcggtcatctctttcgttggccggtgctccagcagaaacttcagatatccgtaaatgttcaggtcgtgcgcctttgccatctcaaccattgtataaactacagcactggcattggctccggagacagaatcactgaacagccagttcttccggccgactgcaaatggacggatcgcgttttcgctcagattgtttgtgaaactacagcggccatcctccagataagtctccgctgttttccgccggttaaggacataattcaccgctttatccatgcgggtattccggactggcttctgctgctcaagccacaaccaaaaagcctccagaacaggtttttccttctcgagacgcagctgcttccgtttttcataatcaccgggatattttttgttaatggaatcctctatggcaaacaggcggttacagtactggactccctgtactgcaggctggctgtaatcatacggtttccctttgggaacggcgtcgataaagtaccggcggatgtgtgcccagcaggaacatcgtttgatatccggcaggctgttgtagccctgataaccatccgtttccagatacccatgatagccttccagaaattcctttgcatggctgccgctcctggttggtgaatagccatataaaataatggcaggaaggccgtcttcgccgctgcggaacagccacatgaaggattgcgtctgtgcccggcgttcttcttccttcagtacctggactcgggtctcatctgccattgcgaagctgcgcttcagcagttcccggtgaaagtaatcatacattggctgaaagtaattcccggagcaatagatgatccagttggcaagtgtcgtcctgctgatctgggcaccatactgtttccagtctttctcctggcggtacaggggaagtccattcgcgtacttctgatacattgtccatgcaacggtggatgcggtcgccgggccttttcctaccagggcctgtggaacctgggactttataatcacaggtttttccgtgtctcccagtccttccttacaggacggacatccataactctggctgtagtattcgatcactttacatgtggccggaatgaattccagctcacggcggacatactcttcgccgatcagaaccatctgcgtaccgcagaccgggcagacctgctcttcttccggaagagggatgactgctttttcaaccttcaggcctttaaaaagatcctcatgggttgctttcttcttgcgggtatgctcccggatcacggtctcttcttccaacatggaaggatcctgttccacttccgcttcatcaaaaaggttctgctgccctggaatgtcatcggttcttttttcgctggaggaaccgaaaagctttttggtcagatagtccacctgttcctgaagggctttttcgtggctggttttttcgtcaataacaagacggagagacctgatcagttccgtctgctcagagatcattgttttcagttgtgttatagtgtccttcagctctaaaagctggatgtcttttgcactggaagccatcgttctctccttggatttgataccttcattataccagaaatacagacattcctaaaggaaaacaagggttgaaaaacgctgaatttataaggaaatcagacatttttctgtgcaggatttttaccgggatccagctgcttttttactctgctttgagtgcttttggctggtcgatatcaattcctgacatcagccagtcgaactcccgccaggaaagattccggacttccgactgcttccttggccattgatagccgccccggacagacaaccgtttatagatcagaacaaagccatccggttcacggaacagagctttgatcctgtcccgtcttcttccacagaacaggaagagcgcactggatgccggatccatcttaagctggtcttcgatcatggcacagagaccatcgatcgatttgcgcatatctgtatagccgcagacaatgtagatcttttcgaggctggagatatcacctaacatgcggtctcccggatcaggcggagtgtcctggtgagcaggacaggatcggcatcattgctgatgcggattgtcacatcattcatggacacttcaatcgtatgtgaattgtcaaggttcgtttggtgcatctgtgatgctatgtgctgttccgtaagtcgatccggaacaatgtcaatgggaaccacgtcctgctttgaatgcgggatcacacaatgaccataattcggtgccgggatctgatccgctgctgttttcctgcagcggctgacccagttataaaaagtgcttacagcgataccgttttcacggcaccagtcagcatctgtcatgccgctttggcggcattcattgataagcctgatctgttccgccatcggaacacgggctttgcgtgtagctgtcataacctaccctccgtaattgtagtgaaatagtctaaatatctttcatttacaattatagagaaaaccagagtattaggaaatccgcaagaatatttggcgcttacgaaccagcggaagattcattacggaggacctgaatatgatcgataacctgaaaacggaactggcatctgaacagatcaaagagttcctggataaaatgcaaaaaataggcctgtcaaaagaagacatcatagggctgatcaaaaaagttagcgaggaggagaaaaaatgagtacgattctggactgccggggcctgaccaaaaggtacggcaataaactggcgctggaccatatcgacttgtcactgggccgcggtaagatcatcggtctgcttggccccaacggcagcggcaagaccaccttgatcaaactgctgaacggccttctggtacccaccgaaggagaaatctttgtcgacggcaaagcccctggtgtagagacaaaaaaagttgtatcttatctgccggaacgcacctatctgaaccgctggatgaaggtatcagatttgatttcttatttctgcgacttttatgaggacttcgacagatcacgggcctatgacatgctgcagaagctgaatatcaaccccaatgaccgtttaaccaccatgtccaagggcaccaaggaaaaagtacagcttatcctggtcatgagccgcagagcaagcctgtactgcctggatgagccgattgccggtgttgacccggctgcaagagattatatcctttccactatcatcaacaattacgacgagaatgccaccatcctcatttccacccatttgatctccgatgtggaaaacattctggatgatgtcatttttatccaaaacggtcatatccgcatgcaggacagtgtggacaatatccgcctggcaaaaggcgtttccgtagacagtctgttccgggaggtgttcaaatgttaaagaaactattcaaatatgagtggaggtctgtttccacgctactatttattgtacacggcgcgcttttaatttatgcactcattggacggatcggatatcagatttatttttcaagatttgtctctgattccggtaataccgtcatgggtatcacaactatgttttatgtgatcgtttacgtttttgggatcatggcagtcctgctcatgactatgctctatctggccatgcatatacagaaaagcttcttttcagatgagggctacctgacccacacccttccggtatcacccacacagcttttgctgtccaaaatgtttatatactggatctggactatacttgacatcatttttgttgtgatttccataggcatcctgctgatcaacaaggaaacctggcctgcttttactcatgtgttccgggaaatgtggaataccctcagctccctgagcggcttttcaaatgtggtgaataatattatatacctgctgtcccttttcgtggatttcttctgcttctccaccggactgctgatatttgccatctgtctgggcagccagtttaagacccataaggtcatgggttctgtattgtccttctttggcattgttatcataagcaatatagtaaatcttattattacaggagctactcttccgggcggaatcggctctacactgatggttacaagcgccgcaagtgaagtcagcactgccataaactattcttacattgcccagacaatatggtatctcctggcaggtattttcttcttcctcggaagcagatatatcttgtcaaaaaagctgaacctggagtagaataacagtatactatttatactcatatgatcaaaggggggaatgctgatgctgatcgtcacaacagatcacatagccggaagaaatattgaaatgctgggtctggtaaaaggcagtacgatccagaccgtgcatatgggcaaagacattatgaacggcttcaaaacactggtgggcggcgaactgtcttcatacaatgaaatgatgaatggagccagagccttggctaccaaacgcatggtggaggacgcacaggctatgggggcagatgccattgtatgtatgcgctactcttccgcgtctgttgcccaggccgcggccgaggttatggcctacggaacggcagtaaaattcatctaaacaaagctgtacagcaaacgactctctgtttatttcggagggtacaaaaaagagatgacataggaaccgaatcatccggttctgtgccatctctttttcttcttatcgccttatatcatattaactattcgctctatatcattttaactatctgtccggcaaggctctttactgtataattgccgtttccgccttccacatgtacagatatctcaccatcccggcataccgcatgggctttcatcactacattgcccctgcagtccggaatttccacatctgcttcttttccatccgcgaacaccgacagaagaagggtcacgccgtccgcaaagtcatattccggttcccggtcattatttcccataggcagaatggtgttttcctttaccatcagcggcagggaatgatagtcatgggtttccttataccaggttccgccttcccttgtctctcctgtgatcaggttcacccaggttcccttcggcagatagtaatccacttcacctgactccttaaatacaggagccgcaagcagggaagaaccgaacatatactgacggtccagtgtatcgcaggccctgtcctccgggaaatccaggaacatgggacgcagaaccggtgtgccgtattcatgggagcgcacagcctgtccgtacagatacggcatgagacggcatttcagattgacaaactctttcaggatcacacatgcctcatcatcaaaaagccacggcacacggtaagaagaagaaccgtgcagacggctgtgtgagcttaaaagtccgaactgacaccagcgtttgtaaatatccgcaggcgctgtctgttcaaatccgctgatatcatggctccagaaaccaaaaccgctaagagaaagggacaatccgccccgcagggtctcagccatggaaacataggttgctgagcagtcaccgccccagtgtgccgggaacttctggccgcctacggttgcagaacgggcaaagagcacagcctccccttttcctctttcttcctccagaagctggaatacggtctgattgtataagtaggtataataattgtgcatcttaaccggatctgaaccatcaaaatacacgatatccttaacaggcaccctctcgccaaagtctgtcttgaagcagtccacacccatatccagcagtgtcttcagtttgctctgataccatgcacaggcatccggattggtaaagtccacaagacccattccgggctgccataagtctgtctgccatacacttccgtctgtgcgtttcagcagatatcccttttccctgccttcctcaaacagacaggacttctgaccaatataaggattgatccatacacagatcttcaggcccttgtcgtgatatctctgcagcatggatttgggatctgtggtcacattgggatcccatttaaaattgcaccactcaaaagcttccatccagtaacagtcaaaatggaatacgtgcagggggatatccctgtctgccatcccctgaataaatcctgaggtggtattctcatcataatctgtggtaaaggacgtggtaagccagagtccgaaagaccaggcaggaggcagtgccggttttccggtcagctccgtatatttctccacagtccccatggggcttttgccgctgatgaaataataatccaggcgctctccttccactgagaactggatcctctccactttctcactggcgatctcataggccacgtcgccctcattgtccaccaggactccatatcccttgttggtaatataaaacggaatgtttttgtaggcaatttcgctggctgtaccgccgtcttcattccacatttccacggtctgcccgtttttcacaaaaggtgtgaaccgctcgccaaggccatatacatactcatccacatcaatgagaagctgttccaccatgtaatttttcccggtctccctgttatgcatatgtgccaggttacggaaactggactctgtcaggaatttatccccctcataaaaggccagcttgtaagcattcggtgtcttgtcgatcacagccctcagacttccgcttgcaaaagtcagacattcctccgtctcggtgatctccgcgcggggatgctcatttttgatctctgcgaaaggccctttataaagtgcgcctgcatgatggacagcagatacctttatcactccctccaaaggtgttgacagagtaatggtcagcatgggaatgttcagggcatcccctctgccagcaatatgttttcccggaagataaacggtcagttcatctcccttaaccatatgactcccatactctacaccgtaggccggggtcatttcatctcttaacatccaatatccattggtaaatttcatagctgtggttcctccagttcttctattttgggttcatgctttttgagtacccgctccatgaattcagagcagagcagggacgctgctcccggtacaacgatcatagtataaggtatccatgccacaattgcggcagaggagactaaaataaacagcagcacagccgttgtcaggaaataacgccctgtcatgaacatggacagctttaaaatccatcccataggcatttcaaatctggaaagtgcagggaaagcatagcagagcattcctgccgcatagatgctgactccatagtaaaggcagataaaaaacagtcctatatatcctgaagtctttgcttccaaaatccctatatttagctgcaggataaacaaaacaaccgcaaaaaggatttccaggagaataccgtcttttagatttcttctgtatgatttcagaaactgttccagtacgtatccctcttcctttttgatcacctttaccgcggtataatacatggcagttgtagatacaccgatcgttatgatggggaggcatccaatcagccagaataaactcagcacgatcgtgttgaatatcttatcaatcacctttacatatttaccgtcataaccaaatatcgtaccattgcccatatgtcatccctgctttctttccttttatatcatttgccaggcggatgctctgcaccgcccggctgactgatcatattaaaaaatgtcttccagttcccctgcttttacaaataccggaatgctgtcatacggagcatcgcacacatactcagcaccgccttcatatatcctgctgtcgttaatgtttttccattttccttccggcagataaaccttgcgttccctgacgccttcatacagtaccgggcagacaagcaccttgcttccgaacatgtactggtcctcaatttcccaggcttttttgtcccccgggaaatcatagaacagaggacgcatgatcggtgtccctttttcatgggcatcctgcatcagtgtctttacataaggacgcatcttctcacgcagttccatatactttttgcagatttcgtatacttcttccccgtagctccatacttcgttctccgcgccgcttatatgttttcctcctcctgtggttcccagaggctctttaaacggttcacggaacccgtgcagtctcatgaccgggcagaatgcgccgaaagcaaaccatctgacaaaacactccttaaacgcatcgtcgtggatattgccgccgtggaatccgccgatatcggtagtccaccacggaataccggagattcccatgttaaggcctgccgccaactgatttctcagggcgcggaaggaggagtcaatatctccggaccataccagcgcgccgtatttctggctgccggcccatgcgcagcggagaagattgacgatattctcctgtccctctgcttccattccctcataagccatgcgggcgtaatatttgggatataaattacccacttccatatcagcacccaggaaataacggtaatgttcgtattcatatccggtaaactcaggctccgcctcatccagccagaaaattttaatacccaggtcataataatttttcttcattttttcccagacataatttcttccctccggattggtcacgtctataatgcaggcgtctccaagctgtccgatgcgctttccgtattctgaccgggtcagatagcccaactccgtcatctcctcatagttctcgctctccgcgtcaactgtgggccagatggataccatcagttcgattcccatctcttttaattcccgcaccattgctgccgggtcgggccaataatcttcatcaaacttccagtctccctgatggggccagtggaagaaatccacaacgatcacatcaatgggaaggcctcttctcttatattccctggccacctccagaatctcatcctgggtctggtaacgcagcttacactgccagaatcccataccgtaatccggcatcatgggaacctttcctgtggcatccgcataggcttcctcgatctcagccggggtatcacccgctgttatccagtaatccatctgctttgtagactcagcgatccactctgtaacattttttccaaaggtcacctggccgatggccggattgttccagagaattccgtatcctctgtctgacagggcaaaaggaacactggcctgggaatttctatgcgccagctcaataatacagcccttcacatccaggtatggctgctgatactgtcccattccgaaaatcttctcgtccttgtatgcctcaaaccgaacagtcagcttgaaattgtcagagcactgacgaggattaaaggttctgggcacgatctccagggcactggcgaatttgtcacttccctcatacatgtctcttgtgcggtcatactcttccagaagaagctttccattctgattataatattggagcactccattgtccatgattttacaggttaaattgccgttggtgatgaccgcctttttcccttcaatggtgatctgtacctctgtctcttccggctccaaaagcgcgctgtccgtatccggaatgaactcacttcgctgggtagcacggacgcgcaggctgttcttcccccacggctcgatcaaaagcagttctttatcctgccttctgtataatttgttgcccacttgtttcagcatttaagtacctcctctagtataataatggtgtagtcaagaatgactactggttaatagttacaaagtccaatctaataaatctatatagatataacggaaggaggagttccccctccatcagaagttataaagtaacattatttaccatgtctgaggtttccttaatgcaccagacaaaagatagaggtataatcactggaggcaggatcattgacgacacctccttgggaaccggccttccggctggtgaaacctcttagaaagtctgtcagtccattcggtggtgatttatgttttggctggttgggaagccccaggctaatacctgtataaaccgctaggttgtgtatccaccttttggaaatggatgcctgccagaaaggataaaaccatgaaatacccaaaagtacttatgatgcttgaaagcatcccttatctctcagtcgggcttgatgtcggtgcagacttcacctggatgtccatcatgctgcccaatggcattctcaccgggaaaccttttaagatcattcattctgatccgcagtcccgtgagcttgctgtcgcaaaaataaaggaagcacaagagatgtattccctcgaaagccgctgcttccttgagtccaccgggatctaccacatcccgctcctgtacttcctccgtgataaggggtttgactgctcagtcattaatcctatcatcactaagaatagcacaaatatgaacgtaaggaaactgcataatgataaatttgattcaaaaaaagctgccaaagtcggcctggatgcttcccttaagacttccatcataccagatgatgaggtcattgacctgcgcaacctggtacgggactactattacttcaaagacctgcagtccgctgtcgtcctgaagctcacggcggaactgaaagtgtcctttcctgcataccggaaggtgtttagcaaggtcactacccaaacttccttaaagcttctggaagcttacccccttgccgcagacatgcttgccgccccaaaagacatacttgtggaaaccatacgcaaaaccgcacgtttcggtgaaaaatatgccgtttccaaatatgatgccatacgtgctgccgcaaaggacgccgctgttttcggacgtgcgcttcaaagcagtgcactccggatccgactgtatatcaaaacctaccgggaataccaggagcatctggacaatatacttgaggacctgcataaggctgttgataagctggaagggacgccggtttatgaccgtatcttccttctccagtccctacgtggtgtcggttttctcagtgcagccgtcctgatcgctgaaatgggctcctttgacctgttttcttccccaaagaagctttatgcttacttcggcttggatcctgccgtgaagcaatccggcaagttcaatggggataaagtccacatgtccaagaggggttctagccttgccaggcgtatcctgcatatggtggctatcaataatcttaaggtggataaagggacaaaaacaccagtaaatccagttatccacggctattataccgacaaatgcaaaagcaagaagaaaaacgtggctgtcggggctgtcatgcataaaatctgcaatatcatttttgccatgctccgggataataaaccatttgagatcatcactcctcaggaacactgtgagcggtatctggcagcgcatcccgacaagatacagaacgcagcctaacaggtttatcatgaattttaaagatttccacatgggtgggcttattaaagttacccttttttacatcaactgcttgaaaaaaacttttttaacatttttcattttacctattgacatttcttagctggacttttcaaatcctttttagacactctccggtcttttcttattttataaaagggctgccccagttttacgtgcagcagccccttctttttagaagttcagttcaaaatcattttttgtaaacagcgggatctgttcaataggtgtcggcaccgttacagtctgtccgccttcgtatgtctcgcctgtccatacatttttccacacagctcctgtgggaaggtagacttctttttgtgtctgtcccttctccataaccggagctactaatatctcaggcccgaacatgtactgtgtctcattatcccagcaggccttgtcccccgggaaatcataaaacataggtctcatgaccggagttcccttttcatgtgcctcctccatcagacggcgcacatagggacgcatggcttcacgcatttcaatgtatttcttacagatctcatagactttatctccgtaagaccagatttcattgggtgccccggatacgcactccgcaccgccggttgttccgtactgaggctggtatggcatacggtatccgtgcagtctcatgacaggacagaaggtgccgtattcaaaccatctgacaagtacctcgtggaaatcctcatcatagatattggctccgaaaaatcctccgatatctgttgtccaccagggaattcccgcgatccccatgttgagtcccgctgcaaattggttctgcaggctctcaaaggaggagtggatatcacctgaccacaccagtgctccgtatctctggcttcccgcccatgcgcagcgcagcagattgacgatattttcctgtccttcctttttcatgccttcaaagaaggtctgtgcgtacattgccgggtatacatttccaatctgtacgttcggtcccagatgataacggtaattctcaaagtcatacaccgtatattccggttctgcctcatccagccagaaaatcttcacacccttgtcataatagttctgttttgccttattccagacatattctctggcttccggattggttgggtcatactggatggtattgcccatatatgtattgtcaatacggacacctttttctacccttgtgagaaggccctttgccttcatctcctcaaaattctcactcttataatccaccataggccagatggaaaccataagctcaattcccatctccttcagctctgcgatcatggcatccgggtcaggccagtaggtctcgtcgaatctccagtctccctgcttcggccagtggaaaaagtccacaacgatcacatcaatgggaatctgacggcgcttatattctctagccacctccagaagctcttcctgtgtctgatatctgagtttgcactgccagaatcccataccgtattccggcatcatgggtacctttcctgtggcgtctgcgtaggcttcctcaatttcagcgggtgtgtcgcctgctgtgatccagtaatctaattttttagtggatcttgcctcccatgaggtaatattcttattaaagctgacacgtccgatcgcagggttattccataagaagccatatcccagcgatgacagggcaaagggaacacttgcctgggaattcctgtgtgccagttccagttccgcccctttgacatttaagaatttctgctgatactggcccatgccataaatcttttcattgggattggattcaaagcgcatggtaagctgataatccccgccgatgatcggtttgaattctctcgcctcaacctccaaagaactgcaggtatccgcaaacatgtcctctctgttgcggacatattcctcaaggagcacctcacctttctggttgtaaaatgtaatctttccaatattgttcactactgctttgatatttccgttgacaatttccgcggaaaaatcatgtattacaatcctggcttcttcgcgtccttccggctttccgtccagtgcccaaagctcatccggcatttcaggcattttggaggcccggaccctcaaactgttctttccccagggttccacaataacccgctccgcatcataacggtaaaataatgcatgatccttttcctcaaaatatcccagtaaaaatttattgtctgagcgaaaatctcctgtggatgcgtcttctctttttacaaaatccgtcatttcttgtcctcactgttataaatttcagtaactgttccgtacgctctcggttaccttcttaattattcttttaccgcacctgccgtcaggccgcccacaatatatttctgcaggaatacaaacaacaggataaccggcagtaccagaatcgcgccatacgccatgatacagttccactttgttccgtatttactctggaatttataaatattggctgtcaaaggacgcatatccggtttcacgttaaaggtcatggagtatgccaggtcgttccagccgcccaggaaggagataaccactactgtgatgacacctgtcttaattgccgggatcatgatcttgaagaaggaccggaacacaccgcagccgtcaatcctggcagcatcgtccagggatgtgggcacgcttttgaaataaggtctcagggttacaacaataaacggtacagacccggaggcgatcgccagggatgggcctaagtaggttcctaataaatgcagcttgttaaagatcagatacataggtgtcagcataagagatgcaggaagcatctgggtcacaaggaatgtgagcaggaatacttttctgcccggtactttataacgtcccatgccgtaagctgccggaataccaaataccagtgagatcaccatagataaaaaggcgatacagacactgttcctcagagaggataaaaactctgcatcctggaagtttttgatccagggttccagggtgaaatggtgcggataatatgtcaccagtttaccgaaggattccgcatctgatttaaatgacatagccagaatccagtagatcgggaacaggaacagaatggcaacaataaccgcaataacacagttgatcatattttttcttttttctttggaacttgttatttttacttttcctgccattctaatcatcctcctttgatatgagacgcaagtagaatagtcccacaataaacagacacgcgaataagatgatcgccgctgtagaacctaaggagaattcatactgtttaaaggacaatgtataagcataagtacccagaacatcagtagagttcagaggacctccgcttgtcataacaaacatcagatcgaatgctttaaatgtatagataaatcctaacataagcactgataatatagccggtttcataagcggaagtgtgatataaagaaatctctggaacggatttgcaccgtcaacttccgcgctctcgtaaatctcagtggaaattcctgtaagacccgaggtcagaagcagcatattgaacggaataccaacccagcagttcaccgcaatgatggcgatcatggctgtacttccgctgagcagccattccaccggagcactgatcagacccagcttcataaataggtcattgatcacaccactggacacatcgaacatattcttgcccaacagagccgtaacagacattggcatcatatatcccaccaggatcataccacggatcggtccagcaagtgtaaatttctttgagaaaaacaatgcaaatataaatcctattgtgaactgtacaaccaaacatccgatggtaaacacaaatgtattcttaaataccatcaaaaatgtttcattgtgaaataattctatgtagttggacaaacctacaaatacatctgttccgcctttgaatgtcttaacatttacattcctgaagctgagtacaaagttgtacacaagcggatatccaagaaccaccagcatataaatgaatcccggaaggataaaggtatagccttctcttctcttttttgccgccatcgacattttcatggatttcacccctcttccaaattcctatctgtttcttttaaaaaggtttaagatgtatcgccgggatacaccttaaaccttgttttacagtcagtatccagacttcttgcagcagttcagccaaccaaactgcagcctattctgttttacttctgtactgcaataggtgtttcttccaaaataggtgaaatcgttgcctgtgcttctttcagagcttctgccgggtctttgtcacccagtaaagctgcctgctctgctttgtacagtgcttcggaaattgtcggccaggactcgtgaggtccccttgcaactgcaaattccatggagtcattgaatactttatatctctcatctgctgtccagaaatctttcagttctactgcgtctgcacgaaccggtaattttcctgcgatctcacaccagtctgctgtgttctgtgcggactgcatatatttcaggaattctgtacactcttctacattttcggaaccgctgcatacaccgaagttctcaccgccgataacagttgcctgctgctcacctttcggcattggagtatacttgtattcccatgtaacatcatctttattatcggtatctaaggttgcgatctgccatgtaccggattccagcatagcggctttacctgcgatccatgcattgtaagcatcgccctgtccccagtttacagcttctttactcatatatccgtcttttaccaggtcacttaagaatgtcagagcgttcactgccttgtcgctagaaacatctgtgatgtctgctccagcgccgtacagccacggaatgaactggaaggttccctcttcattagcgatggctgacatagcaaatccgtaaactccgttggcttcgtctgtggttttttcacaggcttctttaaattcgtcccatgtggtcggcggattttcaatacctgctgctttcagcatatccatgttgcacagcagtgccagacagtttgagttgttgggcagtccgtaatattttccgtctgcgtccatacaactgctcagaggtccttcatagaactgatccagatcagaccatccctccagatactctgtgatgtctgcgaacacccccagggaaatgtaggatgccatatccggtgaatccaccattccgatatcaggaagttctcctgacacagcaccgatggtatactgtttcattaactcatcacgtgatacaaaagtaggtacaatgtagatatcactctgctcttcattatatttctttacaaccgcattcagggcgtcagcctcatgctcgaagtagtgccagagggtaacttctttaccgccgttaggctcccctatgtctgctgcagtggcttctgttccggtctcagtctccgcggaacctgtatccgcgtcgtctgcggtatcctctgtgccggtatccgtactgtcgctcttcgtgtcaccgcctcctgaattaccacagcctgctgtcatagccaccaccattgcagatgtcatagtcagcgccaatgtcttaacaactttcctcttcattttgtttcctcctagtataataatggtgtagtcaagaatgactactggttaatagttacaaagtccaatctaataaatctctatatataacgtaaggaggagttccccctccatcagaagttataaggcaacattatttaccatgtctgaggtttccttcatgcaccagacaaaatatagaggtataatcactgaaggcaggatcattgacgtttcctccttgggaaccggcctcccggctggtgaaacctcttagaaagtctgtcagtccattcggtggtgatttatgttttggctggttgggaagccccaggctatacctgtataagccgctaggttgtgtatccgccttctggaaatggatacctgccggaaaggataaaacaatgcactatcaaaaagcactcaagatgctcgaaagcatcccatacctctcagtcgggcttgatgtcggcgcagatttcacatggatgtccatcatgctccccaatggcattctcactggtaaaccatttaagatcattcactctgatccacagtcccgtgagcttgccgtcacaaaaataaaggaagcacaagagatgtattctctcgaaagccgctgcttccttgagtccaccgggatataccacatcccgctcctgtacttccttcgtgataaggggtttgactgctcggtcattaatcctatcatcactaagaatagcacaaatatgaacgtaaggaaactgcataatgataaatttgattcaaaaaaagcggcgaaggttggtctggatgtctcccttaagacttccattgtcccggacgacactatcattgacctgcgcaacctcgtgcgtgactactattatttcaaggatctgcagtccgccgtcgtgttgaagcttaatgccgaactcaaagtgtccttccccgcatacctgaaggtattcagcaagatcacaacgcagacttccttaaaacttctggaagcttatccccttgcagcggacatgcttgccgccccaaaagacgagcttgtgaaaatcatccgcagcacggcacgctttggggaaaagtatgcccttgccaagtatgattccatatgcaccgccgcaaaggatgccgctgttttcggacgtgcacttccaagtaacgcgctccggatccggctgtatatcaaaacctaccgggaataccaagagcatctggacagcgtactcgaagaactgcataaggctgttaataatctggaaggaacacccgtctatgaccgtatcctccttctccagtccctgtggggtgtcggcttcctcagtgcggttgtcctgatcgctgaaatgggctcctttgacctgttttcttcccctaagaagctttatgcctactttggtctggatcctgctgtaaagcagtccggcaaattcaatggggacaaagtccacatgtccaagagaggttccagccttgccaggcgtatcctgcatatggtagcgctcaataaccttaaggtggataaagggacaaaaacaccagtaaatccggttatccacagctactatgccaacaaatgcaaaagcaagaagaaaaacgtggctgtcggggctgtcatgcataaaatctgcaacatcatttttgccatgctccgggataataagctgtttcagatcatcactcctcaggaactctgtaagcagtatctggcagcgcatcctgacaaggcacggaatgcagcttaaccagttctcataaatttttaagtttccacatgggtgggcttattaaagttaccctttttttcgtcaactgcttgaaaaaacttttttaacatttttcattttacctattgacatttcttagctggacttttgttttttcgtttcttaggatgttcttattatagcggcaaaatgccatttcaaaaaccgccgcttttaagattgggattaattttttagggtatttttttaatatcggagtaaaaaattaatattttttatttttcgttgtatatattgtacattttagtcatataataacagcattttacacacaaaaaagcgagacattaacgtctcgcctttataaactccgtcacattgactcccgtctcttccttgaaacatttgttaaagtatttggggtctgagaatcccacactgtacagcacttcgtccttagaaatattgccctccagcagcagttcctgggctttctcaatccggtaccttctgagaaatctggaaaaattctcaccgatatctctgccgaacagataactgaaatattctgcactgacccccaggtctgccgctaaatccttctgtgagattttggatgcataggagcattctataatatgcattgcttttaagatcagcgggtgcgcattggggtatctgctttttaaatccctgttctccttatcccaggtaatgctgctgttttcttccagcctgtgaataatatcctcgatatcttcaggtaccagaggctttaccagatagtctgtgactccaagagagattgcctgcctggccagttcaaattcctcatacgcactgattataacaaactttatcttcatatcctgcgctctggccgctcttatgagggatattccgtccatatacggcattttaatatctgtaaagaccacatcaggctctaaaagcttcataagctcaaatgcctcttttccgtctgcggcctcccccacgatctcatatttgtccgataccatcatgatcagattcctaagccctctgctggcccttttttcatcttccgctataagtattctcacatcagttcctcctcctggcatatctccttctgtttttttagctcagattccgggatcgggatccagaacgtaaaagaggttccctcacccagtcctgtctgcatttggatatccagcttctctccataatacatccgcattcttgtgacaacgtttaaaatccctatgcctaccttctgccgctgcagaacaggagccattccctttgactttaagatattttttatcaccttttccgtatctgcgtcaattccgctgccattatccctgatctcgatcctcagacgtcccttttcctccgatacggtgatcttaacgatgcctccttcatgtcttccctcaaagccatggaggatagaattctcaacaaagggttggaacataagtttgcagcagggccaataaccatattcctcctcaaattcgatggaatagtcaaagacattctcaaatcttgttttctgcagatagagatactgatcgatccatgcaatttcctggtacagatagacatcctgacatttctggtcaaatgtatagcggagtatattggaaagctttttgatcaggacagatacctgacggtttcccgcctctatagcttcataattaatggtgcccagggtattgcatatgaaatgtgcattgatctgggattcaagggcttccctctctgcctgatgctgacgctcaatggatgccagcgtttcctcgtgctgcctcttcatagctatatttttttcttccagggcttctatcattttattgtactcatctgccaactgccagatctcatgttttccttctatagaaatcttgctgtggaaattgccctttttcacggttttgatggactcggaaatctttgtgaccggtttgagaagataccgcataaagaaaaccgtcaaaaagatataggctgccagtatcagtatatagatcatcacacccctgttgtaaatctgatccacatgctcctgcattttatgctcatccataagaatgttcatggtccacccaaagtaacccagctcccggctgataatctgtatatcatcatcccgcaccaggttatcctccgaggtaccgatatattggtccatgttatgatacaggatctgtccattctcatctgctatgtagccctgggcgtattttactttgggaatctccactgtattgagaaattccttaaagacatccatattatagctgacgatcagaacattcttcacttttctgagaccggttctgttgccgatcaggggatatgccacgtgaaaaagccggagatcggagtcctgagggtgtactcccggttcagtggatgccatatacagcggaatataataattattggtattgttcatgacttcctgatacatttcctgcaggtacttgtcattctcatcatcccacatggccccgtcagaacgcctgtacctgtcatattggcacaacaggccgtcctcgcccacaatggccactgccactgtgtttttaatatagtcatagtccgacaatgtgttgtataacgcattatatccattgctgtcatagcaggcctgaaccttattatagatatccgcggataccaccatctcactgccgaagtttatatgctctttaatcgagtatttcacatttttctggacagacaccaatacggcattttctgtttcaaagctctgttccaccagataattcaggtattcatttttcaggtatccctgaaatacaagagccattaccaaaacagccagtgaaaacacaagaacaaaagaggaaacaatatgctcttcaaaatatgtttttatccttctgtatatacgcatggaatcctccttctctctttcggcggtcttgccgcctactctgtcttattatctgccgctgccttcacttcctctgccaccacctgtatctgcgcgtccacgtcctttttaaactgttcccaggcatccggatggtccacaaagtatttggggcagattttctctgtcacatcgtagtggcggatcacgtcactgctctttaagtcaaagcggtaacagagccatcccaccagcttgacaagagagtcatatgttgcctgggtaaattcaccggtctcatccttatggcagcactcaatggataacgtatcgtcattgcgggagttggaggcataggctatctctgaactgggaatgcactggacgatctcgccctcgatccctatgacaaaatggctgctcacttttgtctcatggctgtccttcagcccctcaaaataatttctgttttcctctgccgtacttcccggatttgcagtataatgcaccacaatgccttttatctttttcaaaggaatgcccggtctggaatattcatttacatccaacagctccacatcaaaagggggcgcgcctataaagctgccattttcctgggtgacctttgtctgcagcttttccagcttggcatcctgtatctttcctgtgactatttttataacccctattgcaaatatgatccccaacaggaccagtccgaagagcatgagccttttatttctctgcctccttctgtttatccttctgtaatcccttctgttatttcctctcctttgtcccataagcgtttctccccatttatgtacatttcctgcagctctttggcaggcctgcgcatttacctcgctgaccgtaagacagacttctcctttttataagacaaaaggctgttgccactatagcaacagcctctgttcttgtatcgataggagatacacaatgcctgtgcttcctattattcgtctacactgtaattcggtgcttcttttgtaatgtgaatgtcgtgcggatgagattctttcagagacgcggctgtgatcttaacaaactgtccggtctgcttcagagtctcgatatcctttgcaccacaatagcccataccggagcggagaccacccactaactggaataccgtatcctccacatggcctttgtaagcaactcgtccttcgacaccttccggaaccagtttcttggcattctgctggaagtagcggtccttgctgccgttctccattgcggcaatagaacccatgcctcggtaaactttatattttcttccctgatataattcaaaatctcccgggctttcgtcacatcctgcgaagatactacccatcatgcagacattggctcctgctgcgatcgctttggtcatatctcctgaatatttgataccgccgtccgcgataatgggaatacccgcttcttttgctgctgcgtagcactccatgatcgctgtgatctgcggaacaccgataccggctaccacacgtgtggtacagatggaaccaggtccgataccgactttgacagcatctacgccggcctcgatcagggcttttgttgctgctccggttgccacattacctgcaactacctgcagattcgggtgttttgtcttgatttctttgactgctttgagaatgttagcggaatgtccatgtgcggaatccactacaatgacatcaacctgtgcttccaccagcgcgtccacgcgggccataacattggctgtaatgcctactgctgcgccgcacagcaaccttccctgctcgtcctttgcagataagggatatttgatctgtttctctatatctttaatggtaataagaccttttaagttgaagttttcatcgacgatcggaagtttttcttttcttgattttgccaggatttttttggcttcctctaaagtgactccttctctggctgtgaccagattttctgatgtcatgctctctttgatctttttactgaaatcctcttcaaatttcagatcacggttggtaatgatacctaccagcttcctgccctcagtaatgggaacaccagaaatacggaattttgccataagattgttggcatcctccagagtatgctcaggggaaagatagaaaggatctgtgatgaccccgttctcggaacgttttaccttgtctacctcatctgcctgtgcttcaatagacatatttttatggatgataccgatacctccctgtctcgccatagcaattgccatacggtattcggtaactgtatccattcctgcactcatcatcggaatatttaacttcactttttttgtcagatttgtcgacaaatcaacctgattggggattacttcagaatatgccggaaccagcagcacatcgtcaaaagtaatgccttcaccaataatcttacccatttttgttctcccttcgtttgtttatagtaaaataatataacaaattacgacaaacctgtcaatccgtaaaaacttttctcggacagcttttttctatatttttgatcaattccatgtccggctcgatcagcactttacaaacttctttgtcgtccgggatgatcatggcataaatcttatgggatggatttccggatgaaaaatcgtaaactttaatatttttattgtggttctggtaatccagacgatgtgactgtacaggagccataagctccatcttggagagatccaggctcttgaccctcttcctttttgctctggaagcgatcctgtcaatatccagctctccgttcacatagagatattcaaattccagatccaggttcggcagcagaaaatacgcagccgctcccagaactacagctacaaccagggcgatgggtgtaatgaaaataccggctactgccgccagtacgatcagtgcgatgaccaataccttgattgccttctcttttatggtctgctccttttttacgagcagttctgagtacgcgtcgttcatgttttcctccttaaatgtccgcttttatgcagcccgttcagcaggtctgtgcatttgccgcactgaacagcttgggcttttgcttataagtctatcacaaagaaatgccggtgtccatatgacaccggcataagaaatgtgaaatttctatatatatcttacatcattcccattccaggagcaccgcctgccggcatagccggtgtttcttctttgatattggaaacaacagcttctgttgtcagcagagtacctgcaacacttgttgcgttctgcagtgcgcttcttgtaacttttgtaggatccaggataccttcttttaccatatccacatatttttcatttaacgcgtcaaatcctacacccatatcagattcttttaccttgttgatgataacagaaccttccagtcctgcgtttgcagcaatgtggaacagaggagattccagagctttcaggacaactctggcacctgtcttctcatctccatccagttcagcgatcagcttctcaacttctttggatgcatggatataagcagatccgccgcctgcgatgataccttcctcaactgctgctcttgtagcgttcagggcatcttccatacgcagttttgcttccttcatctctgtctcagtagcagcacctacgcggataaccgcaacaccgccagccagttttgcaagtctttcctgtaatttctctttgtcgaattcggatgttgtctcagtgatctgatgtttgatctgagcgatccttgcatcaatatcttctttgttgccttcgccgtcaacgataactgtgctttctttctgtacttttacagattttgcacgtcctaactgatccatggtaacgtcttttaactcaagacccagctcgtcggagatcacagtaccgtttgtcaagatagcgatatcctgaagcatttcttttcttctgtcaccatatcccggagctttcactgctgctacggagaaggttcctcttaatttatttacgatcagggttgtcagtgcttcgccttcaatatcctcagcaatgatcagcagttttgctcctgattttacaatctgctctaagatcggcagtaaatcctggatattggagatcttcttgtcagtgatcaggatataaggatcatccagaactgcttccatcttatccatatctgtagccatgtatgcggaaatgtatcctctgtcaaactgcataccttctaccagatccagctctgtcttcatggtcttggactcttcaatggtgataacaccatcgttgctcactttatccatagcatctgctaccatttcgcctacttcatcatcacctgcggagatagctgctactcttgcgatctgatcttttctttcgatctttccgctcattttctgaatggcatcaactgcaacctctgttgctttcttcataccttttctcaggatgatcgggttagcgcctgctgccaggttcttcataccttcgtttaccattgcctgtgccagaacagttgctgttgtagtaccgtcaccggctacatcgtttgtcttggaagcaacttctttgatcaactgtgcgccctggttttcaaatccgtctgccagctcgatctcttttgcgatggtcacaccatcgtttgtgatgagcggagcgccgaaggatttatccagaacaacgtttcttcctttcggtcctaatgttacacgaactgtatcagctaactggttcacaccactttcaagggcagctcttgcttctgcgccgtatttgatttcttttgccatgatttgattcctcctgaaattaaataatgtctatttctgttttctggttttattcatgttaatagagttttgtaaaataaagatatctgttattttactactgcaaggatatcgctctgcttaacgataatgtattcatcaccatccagcttcacttctgtaccagcatatttggagtagattacctggtcgccttcggcaacttccattttaatctctttgccgtcgatcactccgcccggtcctactgctacaacttccgcctgctgcggtttctcctgtgcctggcccggtaacacgattccggattttgtggtctcttctgcaaccaactgttttaatacaactctgtctcctaatggtactaatctcatatctattgcctccttttaaaattctctgcttgttattagcactcatttgattcgagtgctaaccgttagtcatatattagtgaatctgccgcatttctgcaacttctttcatctccgattagctgagttaattcttacattttatatttttaactctctttttctcttgttttctcatctttttaattttcattgaattttatatttattttagaatctttatatttcagcatgaaatccttttctgaaacaggattctatagcagaagtttagccagaacctgttctctacatacagtatttccggtaaaaaatataaaaacccaaagaaaaccggaggttatttcctactatatgaataacctccggttttctttccctgcatttactgtttttttaccagcttgcgcttcttgatctcttccaactcatcaaatatcacttcattgagtaccttgatatatgttcctttcatacctgaggatctggattcaatgacacctgcgctctcaaacttcctcaacgcattgacgatcacagaacgagtgattcccactctgtcggcaatcttgctggcaaccaggattccctcatccccgtccaattcatcaaaaatatggatgatcgcttccaattctgaaaaagaaagcgtattgaacgcagatttcacaacctggatcttccggttctcctctgcgttttcctcatgtacagagcgcatcatctccagccctaccacagttgtgccatattcgctgacaataatgtcctcaatatcataccccttctgatccctgtacataaaaagagtacccagtctctcaccggcaatatcaatggggctgataatagccatatacttactgatgttctcgccttcaaatcctaatgtctgaagattcacgttctcctttgtggacagcacgcccagcagacgctcattgagcagcttatcaatataaccgcccacttcactgtcgatcaattccgtgatctcctccacacccggacaggtgcccacacccagcaccttccctttccggctgataaccagaatgttagaatccagagtctccaccatcacctcacaaatgtcgttgaacagcaccttagaagagttgttgttatgaagcagtttgttaatctttctggttttatccaataactgtacgctcatagcgacctcctttcactctattcctacagaatataaccctaaatttttattctctatatccttttttattttaacatacaattattctgaaatcaatgtatgatttttttattttctgtctatttatctctttcccacaaacttaactttcaaaacaattgaaatttccccaacttcccttactttgcctgtctgtcagatactttctcttgttctccaactcctctcctttcagacggcagatgtcagatactacttcatacttcgttcatttaaaaagcggaaagaataagcgataagatccgcccggcaaaagcagatcttgtcactcattcttcccgcttattccacagccttccgcccatttaggcctcctgctgtacctcttccttctttcgtatcatcacgaatccgcagtgctcatccgcgcagacaagcttattccccttctccagcatatagcccccacaattggggcatttctctttggaaggtttctgccatgacatgaactcacattccggattattctcgcatccgtaataccggcgccccttcttgcttctgcgaaggaccacatctttcccgcagacagggcagggcactccgatcttctcaagataaggcttcgtattcctacagtccggaaaaccgggacatgccaggaactttccgtgagggccatatttgatcaccatattacgcccacacaggtcacagatcacatccgtcacctcatcttctatcttcacttcctccagctccttctcagcagtctgcaccgcctcttccaggtccggatagaaattccgtataactgtcttccactgcacaagtccgtcgcccacactgtccagcagttcctccatggtggctgtaaaataaacatccacaatgctcgggaaggacttcttcataatattgttgacaacctcgcccagctccgtcatatacagatttttattttcttttgccacataccgccttgcgataattgttgtgatcgtaggagcataggtactgggacgcccgatccccagttcctccaatgcctttacaagggtagcctctgtataatgtgccggcggctgagtaaaatgctgctgctcgtggaatccctggaaggaaagctctgtgttctcatccagtccctttgccaggaaagagttctctgtcttctcctcatcctcctgcacatagacagccataaaaccgtcaaatttcagctttgaggcagccatggtaaaataatactctccgcccctgatcttcacggatgtggtctcatatttggcattctgcatcctactggcagtaaaccgtttccagataagctgatacagcctgaactggtctctgctcagggactccttaagagaagctggtgtccttgtaatatcagtgggacggatggcctcatgggcatcttgtattttcttcttcttgtcatccttcttttcctgggtcagtgtgtattccggcccgtattgggaagtgatgtattcgtgagcggcagattcagcctcctcggaaatcctggtggaatctgtacgaagataggtgataacaccaaccgtaccgttccccttgatatcaattccctcatagagctgctgcgccagacgcatagtcttctgtgtggaaaaattcagtaccttagatgcttcctgctgtaaggtactggtggtaaaaggaagcggcggctttttgctgcgctcactcttcttgatctcagccacctcatagctgacaccctccagaccggacaggatcttatccagttcttccctggaaccaatgctcatctttttatttttatttccatagaactttgctaccagcggtttcttctcacccttgacggcaaattcagcatccagggtccagtattcctcaggaatgaaggcattgatctcatcctcacggtcgccgatgatgcgcagggccacagactgtacacggccggcactaagccctctttttaccttggcccagagcaccgggctgatccggtaacctaccatacggtccagcatccttctggtctgctgtgcatccaccaggttcatatcaatatcgcgagcctctttaatagaagcttttactgcagtcttggtgatctcattgaatgtgatcctgcgcatcttcttctcgtccagcttcagcgccttggacagatgccaggaaatagcttccccttcgcggtcggggtcagttgccaggtataccttgtccgcctttttagcggccttgcgaagtcctgccaggatatccccctttcccctgatagttatatatttaggttcgtaatcattctccacgtcaattccaagctgacttttcggaagatcccgcacatgtccgttggatgccatgacctcataatttgaaccgagaaatttcttgattgtcttcactttcgccggtgattccacaatcactaaatatttcgccatctcaacctcccgttctggcataataatttttgactggctctgctacaagccccttcaattccagtttcaataatatttcctgaatttccccaggatttagttctacctgaaggaaaatctcttccagatattttggtctcaaatccagacaactatacaccatttcttcccggcttgcaagcctaaagtttgattttgcttccaaatctgcttttaatttatctgaaatctgaagttcatccagaatgatgtctacggaatttgcaatgcctgcgccttcaaaaatcaagttgttgcatccctcactgagtgcatcccccagacgccccggaagcgcataaacagtccttccctgctccagcgcaaaattcactgtgatcagagaaccgcttttcttccccgcctctatgacaagtaccagatcggccagcgcgctgatgatccggtttcttctgggaaagtggcggggaagggcaggtgtctggggttcatactccgagagtatccctccctgaagcggaatccttctatatatatctatgttctgcctgggataacagatatccgggccgctgcccaagaccgcaaaagtctctcctccgccgtccagtgctcccctgtgtgcccagccgtccacgcctctggccatcccgcttatgatctggatcccaaaccgtgaaagctcttttgcaaaataatatgcctgggaactgccgtagctgctgcaccttctggcacctacaatggccacactctttttccggctgtctggcagctttccttttacgtacaaatattccggcatatcatcaaaacacctgagcctgtccggatatgccctgcttgtcttcggacagcagaatatttcttctctctccatgtacttcataccttcctcttctcaagtcctctgtaacagacagcttcgctgatctgtgattcctttatctcctcctcaccatccagatctgcaatggtgcgtgctgtctttaaaatcttatgataggccctggcacttaaattcatcttttcgtaagctttttccaaaagccgccggccttcacggctgacactgcagtatttttccacctgttttccggacagctctgaattatagcagactggcaggccctcatatcggtcctgctgtgccaaaaacgccttttccacctctttcatcagctctgctgaactctgtcccgtcctgcctccggaaatctcctggtacgtcatacaagccgcttctgcgcagatatcgatcctgtccaatatgggaccgctgatttttcctgcatatctgctgatatccctgtccgtacaggtgcagcgcttcagatccggatacctgccgcagggacagtggttcatagcagccaccagcatacagtgtgcaggaaactcataggaacctatggttctggagatcctgaccttatgctcctccaaaggctgtctcaaaatttctatggaattatgtgaaaattcaggaatctcatccagaaaaagaacccctctgtgggaaagtgtgatctctcccggccttgggatcctgccacctccggccagagcttgaggggtaatggtgtgatgtggtgcccgaaagggccttgcagacatgaagggctgttcctcagacaaaagccctgcgacactgtatattctggaaacctccaggctctcctctctggaaagacggggcaggatggtgggaatcctgcgggcgatcatggtctttcctgccccctggggaccagatatgagaaaattgtgaaaccctgcggcagcgatgactgccgcccgctttactgtctcctgcccctgtatttcctcaaaatccacattgtaaacaggctccgccaacttctcctgctcaccggtcttttggctgcagacgccccatttttcttttcctgacgcatctaaaaattcttttagtgactccactcccaagacttttatcctgcctgcgatccgtgcctccctgcagttgccgcggggcacgatgcacagccagcacccgttctgcgctgctgtctctgccaggggaagaatgcccctgacactgttcaccctgccgtccagtcccagctcacctgccagcataacaccccgcagcttctcactttctataaatccaaaggcagccaaaagcgcagccgcaataggaaggtcaaaccggttcccctcctttctcacatccgccggtgccagattcaccgtgatccttttgggcggaaggctaatctttgcattcctgatggctgtccttacccgctcctgggcctcacgcacctgtgaagacagatacccaaccatattaaataccggcaggccgctgctcacgtctgcctccactctcacagggacgcagtccactccgcagatggctgctgacataacactgctgaacatacagatactcctttcccccgcagcaggacagagatacccctcccaatgcgggcatagaccttcttcattttttattcagatacttcatttaggaatcaatggtggaatcaccgggaaagaaatgcgggaacccgctttctgacttgttattactgtatcatatttttttcttctgtgcaatggcagactttatttttcttttcatataccctgtccccaaatgcatgatcttcagggagatgctgcgccatgcgcagcaaaattccaggtcagccattgcccatatatacacttctctacttctctgcacatcctttcctatactccctgggccctactttacatttctccttaaaaatatgtgaaaacgccagggcatccctataacccacccgggcagcgatctctcctatggtctcttctgtattgcgcagaagctcctttgccctctcaatcctcacctggagcagatactgctgaggcgggcatcccatgatactgcggaactgcctggtgaggccgcttctgttcattccgtattcccgggcgatctgttcaattttcagattttcctccatatgggccttcatatacacagcaatttcctgtatctctgccgccctgcccctggcatttgtgactgcacattccatctgcccccggaaggtcttatgatcttctatcagatcgatccatactttcgtcatacggcagttttgttccaactgttccacatagcccgccgtatccgattccagcatacacttcactgtttttttcaattttgtcatacaattgacatggacatcacgaacagaaaattcccgggaaaatccggcctcctctgcgcattcctgtacctggctgccacaggaacacaggcggatacaataaaaaagactctgctcagcccctgctgttttaacctcggtttccgggaatacagccagcgcttttccctggcttacctcatattcctttccatccacggttatacttccgctccctttggttatgataaataaagcatattccccgtctcctgtccggtacttcgagactccccgccctaaacagctccactgtacagacagcagattcatggcactctgcgcacagtcattgttctgctgccggcttttgtaattcccttccatataaacagtcctctgcttctaccctttttcctaagattataggtcaatttcaccctagagtcaataggtcacaacgccataattgattaacaatggaaaactgttgcaaataagaaaagaggtgtatgaatgatgtccagattaaaaaaactgagaatagaaaaaggatatacgcaaattaaaatgcagcacctgaccggcattgaccagagtgattactctaagatcgagaacggaaaacgctactacacctttgaacaatgcaaacggatcgcacttgcgctggataccagtatggactatctggcaggtctgacagatgagaaaaaaccttatcccagaagctttaactgagtttttttggcagcatacccgtccctaaatgagtgggaaaagcacaatttgacggatttacacatagactataattaaatccctttgaggtaaagctgcttgaaaacatttcttaagcccttgacttccgaagaagaaaaatattatcttcaagaatacaaaaggggcagccaggaagctaaaaatattctcatagagcgcaatctgcgccttgttgcacatattgtgaaaaaatatcaaggggttgaggaagatttagatgatttgatttcaatcggaaccattgggcttatcaaagccattcatacattcaatggggagaaatccaaccgtctctccacctatgccgcgcgctgtattgacaatgagctgcttatgctgctgcgttccaagaaaaagaccaacaaggaagtttccctctatgagcctatcggaacagacaaagaaggcaatgagataaatcttctggatgtgatcgaaaatgaaccggtagacgtagtagaccattattcactgaaggaggatattaaaaagctttacagcctcctggatcagatcctgagcgaacgtgaactggaggtacttaaactgaggtacggactctacggagaaaaggaactgacacagagggaaatagcaaagcggctgaatatcagccgctcttatgtctcccgtattgaaaaaaatgctgtcttaaagctcaggaactgcttccttccgtcttagaatgtcatacagttcaagcccttcccccaaatccacatacagtatctgctggggatgcggggcgctctcacaggaattcccttcctcatcatatatggctttcacagtgaccgggcggttctctccgtccggtttcatagcctctaaggtctctcccacaaggaatttatttctctgggtgatgcggtacagcccttccggtgtcttatcctctagatatcccagatacgtataatccttggcataggtattgctgtcatagatctgtgccgtctcatccggtttgtcatagaagaaccccgtggtgaactgtctgtaggtacatcccatgatctgctcccggtaccagggcatattcttctgataaagctcaggactgtcaagatagtcatctatggctttccgatacgttctggccaccgttgccacatacagggcagtcttcatccgcccttctattttcaggctgtcaatacccgcagtgaggatatcatccatatgctcgatcatgcacagatccttggaattgaagatatacgttcctctctcattctcatagacaggcatatattctcccggcctggtctcctccacaatggagtatttccaacggcacggatgggtacatgccccctggttcgcgtctcttcctgtgaagaaattactcagcaggcatcttcccgaataggatatgcacatggctccatggataaaggtctcaatctccatatctctcggaatattggcccggatctcccgaatctcctccagggaaagctccctggcacacaccacacgcttagctcccagttcatgccagaaccggtaagtgccgtaattggtgttgttggcctgggtgctgatatgccgctcgatctccgggcatacttcctttgcaatcataaaaacaccgggatctgatatgatcagcgcatccggctttatcttttttaactcttcaaaatattcccgtacgccctccaaatccctgttgtgggccagaatattggctgtcacatataccttcaccccatatctgtgggcaaaggaaatgccttcagccatatcctccatggaaaaattccgggcttttgccctcagcccaaacacctcgccgccgatatatacagcatccgcaccgtatataacagcgatcttcaggacctccaggctgctggcgggaatcagtaattctggtttttttctcatttggcctgttcctcaatgctttctatttctttatactcagagtcactccatctcccagaggcagaatggaggtttccagttcttcatggttcttcagcacatagagatactcccgcatccgcttgtaaatcgtgcggttcctgcgctccacagcaaaatgggattctaccagatccccgtcctgcagcacattgtcagacaccagcaccgcgcccggtgcaagcagtctcaatatctccggaagaaaatggatatactgcgccttggcagcatccataaaaataaaatcatagggaccatccagcgttttcaaaacctgggcagcatcaccgcaaagcagtgtgatctgctcttccttccctgcttttctgaaattctcccgcgcaatgggtatccgcttctcatagttctctatggtggtgatcctgctgttttcaggcgcatattcactcatgagaagtgtagagaacccaacagcagtccccacctctaaaatgaggcggggacgttttatctgaagcaatactttcaggaaactctgcatctccctgcggatcacaggcaccctgtcctccctggcttttttctccagttcgttgagaaagggggtattgcccctgtccagggaattgatgtaggtcaccattctctcgtcaactatcacatttatttcctctgttactcctgttcacctgtgtcagattcaccggattcgtcggattcaccgccttcaccggcatcctcaccgcccgtatccgtgtcaccgccgtctgtctctgaggtatcctgcacagccgaattgccgtccgtgccgtcaccctgcgtaggctggccgtccacattctcccgagccagaattgccatcatctcttctgctgtcatatttgtattcaggatataggtgcctgcctgcagtttgtccttgtaattggacagcttctcctgtaccacaaaaacttttgcatcctcgatcagtccctttttctttaggatctttcctatctgatagacagaggagccatccttgatcacaactgtgatatctgtaccctcgccttcagccatggggacttcattaaaaatcgcatatccgaaatcataggcagacttgcccacaaaaatgacagcaaatataatacaggcatagactgccagtctgaaaaaaccacttgccattatagatgccgcaccctgttttctgattccttttgccatgttgttctccttatttttaaagatccggaatatccaactgtattccctgatggatggacgcgtcaatactctgaagctgtctgcacagcgtaagctccgcctctaaaaaacggttcacctccggtatcctgcacaattcatccatcttgctgtctacatcatcaatcgcgtcatagagattgatctcatcaccttctgcctgaatctgataattcagcttgcgcagttcatctacctgttccttcaaccccggaattgctttgatctcctccagagccgtgcaatactgcttgtagacaacgccgttcttgatcgcatgcaccagcttgtccacgcagacgtcgattatactcatttcctaagcctccatgatgatcggcagaatcatgggatttctcttggtcctcttccataaaaattcacccagggagtccttgataacattcttgatcttgccccagtccgtaatatgcttgtccagacacacatctatggcgtcctccaccacaattctggcctcatccatcaaatcttccgattctctcacatatacaaaaccacgcgatacaatatccggtcctgccaggagacggctggaacgcttctccagtgtcagcaccacgatcatgatgccgtcctctgccagatgctgacggtcgcgaagcacgatatttcccacatcgcccacgccgagtccgtccaccaggattgctcctgtccgcacttttcctgtaacctttgccggttcctcctcattcagttccagcacatcgccggactgcaggataaacacattttctttggggattcccaaatccagggcaagtcctgcctgggccttcagatgacggtattcgccgtgcaccggaatggcatatttgggttttaccagggaatagatcagcttaatctcttcctggcaggcatgtccggatacgtgggcatcctggaagataacgtccgcacctttcatgctcagttcattgataaccttggatactgccttttcattgcccggaatgggattggaactgaaaataatagtatcgtttggtttgatggtcacttttttgtgaatgctggctgccattctggagagggccgccatagactctccctggctgcccgtggtgatcagcgtaaccttctcatccgggtaattccgaagctggtcgatctcaatgagcgtcttgtccggaatcttcaaataccccagctctgaggccgtgccgataacatttaccatgctccggccctccacagccaccttcctgccgtatttataggcagaattgatgatctgctgcaccctgtccacattggaggcaaaggtcgctatgatgatcctggtattcttgtgttccgcaaatatattgtcaaaggtcttacccacggtgcgctcagacatggtaaatcccttgcgctccgcattggtactgtcgcacatgagtgccagtacacctttctttccgatctccgcaaaccgctgcaggtcaatggcatctccaaatacaggtgtatagtccaccttaaagtcgcctgtgtgcaccacgatccctgccggtgagtagatggccagggcggatgcatcctggatactgtgatttgtcttgataaattctatacgaaagcagcccaggttaatggactgtccatgtttgatcacttttctcttagtgcttctgagcagattgtgctctttaaatttattttcaattaatccgatcgtaagctttgttgcatagatgggtatattgatctccttcattacataaggaagtgcaccgatatggtcctcgtggccatgggtgataacgaatcctttgactttgtcaatattgtccttcagatatgtgatgtccggtatcacaaggtcaattcccagcatatcgtcctcgggaaatgacagaccgcagtccacaacgacaatactgtcctcatattcaaaggcagtaatattcattcctatctgttccaacccgcccaaaggaatgatcttcaattttgagttgttattttttttcaagttaattcctccaattttccgttcaaatgtaactgttcagcgccgcaaacgcactgactcacggaactgctccgctcaattttcaaattcaacgtcctctaacatggcctcaaagactttgtaaaccgcatcgtattctgtgtcatcttccacaaacacgtagcagccttcttcctcgccatcctctgaaatgtcctttaatatatatgctgccgccccttcatcgtccgaatcctcagggtctatgaccagcagatatacgcttccgttcactcttgtctgttccagaattcccaactctaattctgttccgtcttctccatcaaaaataattgtctccatacattcttcctttctgtcgttctttttacgtgcataaacgcccaaacccggaaacgagccttcttcccctcaatagtccaaatacggtatcaagctgaaatcaaactgtacccgggtttgcttttgcatccagatagccctgcaaaatgaacactgcagctatcatatccacgtatttacttctgttctctctgcgcacaccgctttccataagtgtgcggttggcctcaacagtagtcagcctttcatcccacatgatcacgggcaggccgcatcttctctccagcatttccttcagctccagagacttctgcgcccgatctcctatggtattattcatgttcttgggaaagccaagaacaatctcttccacctgatattcgctgataagctcctcaatccggcgaagggattttctaagtttattttcatcttcccgacggataatttcgattccctgggcagtaagacccagagggtcgctgatcgccacccctattgtcttagagccatagtcaagtcccatgatcctcatcatcagtcacgcttccaggattcgttcttaatatactccttcagcagctcctccactaactcatcacgctctactttcatgatggtgcttctggcacccttgtagctggtgatataagtcggatcgccggacatgatgtaaccaacaatttggtttaccggattatatcctttctccgccatggcattgtacaccaggtccagaacttcttttacccggacttccggttctgtcttaactttgaaatattgagtatttcctaaattattctccataatctctcacgcccttatctaaacttgtaactattcgggttaccgtccactccacagcctgccgcttgtcaacaagctatgggccatttggcaaaatagccaatgagcactccaaccgccggatagttctctaaaccataaccttattctaatatatcttggagggaaattcaaccattatattgcgcaaataaaaacgccatcttcgacaaatccagcaattttgccaatttttaagcaattctccagattttcttctgtctctgccgccacttttaaatactctctggtatggcctatccagtatgtttttccctggatttcggctttttcctcaaaaaggatctccacttctctgccaagataatattccataaatttctgtttccggcgttttcccaggtctatgaggatatggcttctgacagctttttcctgttccggtatctgtccttccatgcggtctgcccgggtgcccttccttctggaatatttgaagatatgggtctcgtaaaatcccacgctttctatcatagctctggatgcctcaaactcctcctctgactcctgtggaaatcccacgatcacatccgtggtgagagccggatgttcaaaatatttccgcagaagtgcacagccgtccagatattcctgtgcagagtatcttctgttcatgcgttttaaggtggcgtcacagccgctctgcagagacagatggaaatgaggacatattttagataagctgcttatagttttgacaaattcttccgtaataatacggggttccagagatccgaggcgaattcttttcactccctctatctcatggacagccaggatcagctcaagaagcgaatccccacagtccacaccataggagctgagatggatacctgtcagaacaaattcctgatatccgttctttaccagccgttttacctcttctacgacctcttctcttctgcggctcctcacccgtcccctcacataagggataatacaataactgcagaactggttgcatccatcctgtaccttcagataggccctggtgtgctccccagtggaggaaagctgcagattctcgtattccacctgttcttttaaatctatcagctctttatcctggcccttttccctgtcgtactgctccagtacagccagcagatcctgctttttattatttcccagcacaatatcaatggcctcgtcaatctgtacctcatctttttttgcctgtacataacagcccgctgccaccactatggcatccgggttcatcttttttgccttgtgcagcatctgtcttgatttgcggtcggcaatatttgtaacagtacaggtattgatgatatatatgtctgctccgggcgcaaaaggcacaatttcataccctgcctgttccagcatctgctgcatagcctctatctcgtatgcgttgactttacagcccagattgtgcaatgctactttctttttcattctaatcctctttatcatgataattcgttaagcgttttgacgaatagtcgtcggattctttgtattttatttctcccttttttatattgactttttttgccattaacggtaacataagtcttgtaagaagcaaaaaacggaataggtaagggaggatttttccaatgaaaacagtaaaaatttcactgaattctatcgacaaagtaaaatcattcgtgaatgaaattacaaaatttgattatgattttgatttagtatccggaagatacgttatcgacgctaagtccatcatgggtatcttcagcttagatttatcaaaagctattgacttgaacatccatgcagctgatggcgctttagatgacatcttaactgtgttaaaaccatatttagtagactaatcgagattcattccgacaaagcaacaaccgggactgcctgctggcagtcctttttttcatttcacagaacagcctttgctcttgctgctatgaaaccgacaggctgaatcgtatctttactcacagatgatcgtctccgctgtactcacagcttcctccatcatctcttctatcttctcctgaagcttttcctctgagcgtttgatcactttcaggcttggttttgtaacaggatgttttgccacaaaaatggtgcagcagtcctcatagggaagaatagatgtctcatatgtgttgatcttcagcgctacatccacgatctcctgcttgtcaaagccgatgaccggacggaatacaggcatggtgcacacctcatttgtggctgcaagactctgcatggtctggcttgccacctggccgatgctctcccctgtgatcaggcccagacaaccatccttctctgcaaatgcctccgctatcttcatcatatagcggcgcataatgatggtcagctcctcatgtgggcatttttcataaatatatagctggatatccgtgaaattgaccacatgcagatggatgggaccgctgtagcgtgccaccagttttgccagatccacaaccttttgttttgcacgctcgctggtgtacggcggcgcgtggaaatatacagcgtcaatcttcacaccgcgctttgcgatcatatatcctgccaccgggctgtctatgccgccggacagaagaagcatggcttttcctccggttcccacaggcattccgccgggtcctgggatcacctgggagtacagatatatcttatccctgatctccaaatggataaatacatccggcttgtgcacatccactttcatattggggcacgcatccagaaccgctccgcccagctctgcgttcagctccatagaattcatgggatagctcttcttggtccttctcacatccatcttaaatgtcatttctctgctgccgtatacttcttttacataggagacaacagcctttgcaagctcatcatatccctcatcctgcagcacaacagcgggacagataccatagatgccgaacacacgcttcagcgcctccacagtctcctcataatcaaattcgctgcgggcaaatacatagatcctgcctctttctttcaccacatcaaaggacccgtccacatctttcagcacacggcggatctgatccaccagagcgtcctcaaagatgtaccggttctttcctttgatggctatctctgcatattttatcaaaaatgctttatacatatcttattcctttcctttatcaatgccttgcatacctgcgaagcacaggcagtacagttctgatctcctccagcgtatagtcaagctcctcttttgtggtgaactcgctgaggctgaagcgtatggctgactctctgcgttccttgtccgcggatatggcggtcatagtggcacttgcagcccgcttgtggctggaacaggcacttcccgcggacacatagatgcccttttcctccagagtatgcagaagcacttcactcctcacacccaggaaactggcatttacaatatggggcgccccgtcctcaggcgcaggcccattgatgaccacctgttccatggcagacaggttttctgccagatatcctttaagctctctcagtttttttattttttcctcatggttttcatacaccatgcgtgccgcagtacccagtcccgcgattcccggcacattatctgtaccggagcgcatgcccttttgctggccgccgcccagaataaggggctgggtctttaccttttcactgacgtacaaaaatcccactccctttggcccgtggatcttatggctgctcacagagagcagatcgatccccgcgcgtttgggatagatcctgtactttccatagccctgtatggcatccacatggtacacggtctttggattcttctcgtgtaccagctttgccgcggcctccacaggcaccacagctcccacctcgttattcacatacatggtggataccaggatcgtatccggccgcatcgcagcctccagttcttccatggagagatttcctttctcatccacagggatcacggtcagctcatacccctgttccttcagccagttaagaggcgccgaaaccgctgcatgctcaaatgaggtggtaatgatatgcttaccctgacggcagttggcaagcgctgtgcccaccaaagcccagttgtctgattcggttcctcctgaagtaaagaaaatctctttttcctgtaccttcagggttttggcaatggctgctgctgcttctttcacatacttttctgcctccacgccctttaagtgcatagccgacgggttgccgtaatcctctgtcatggtcttcaccacaatatcctttacctcatcaaaacattttgtggtggctgagttgtccagatacgcttccattttattcctccaatgcaaacatgaggacagagaggactgtaagccctgctgtctctgtccgcagaattctttttcccagtgtgatggcctttgctcccatttccacagccatccgcacctcttcctcgtcaaatccgccctccggtccgatgaaaatgccgatggactgacccggttctatctgagcgatcagttctttggtctccttcatgccttttgccaattcgtagggcagaagcaccacatccagcttcttggcctgctcaatagcctggcaaaagcgcatgacaggctttacctccggcacatacatacgctttgactgcttcgccgcgctctccgcaatggcctgccagcggcggatcttgttctcttctttttttccttccagctttaccacagcgcgcctggtggccacgggaatgacctgatgcacaccaagctccacagctttctggatgatcagctccatcttatcaccttttggaagaccctgaaacagataaatcctggaagacagctcatagccggcctcctgcacatacataacatgcgccaggacctcctctgctcccatctcctcaatataacaggcatactccagatcattgccggagcttatgaggatttcctcaccggtcttcatgcggagcacattttttatatggtttacatcactgcccagaatgcggatggtgtgttcttccacctgggaaggctctacgaaaaaacggtacatggataacgctccttaattctttctggcagtcacagatacccactcgccctggtatgtcacctccaggacttcaaggcctgcttccttcactgcctttaccacagtttcttccttatcatctataattcctgacgtgatataaatgccgccctttttcatctggttcagaatgaccggagtaaggggaaccagcacgtcagccagaatgttggcaacgacaatatcgtacttttcatatcccactttatcctggatggccttgtcatcaataatgtttccgatcatcatgtcaaagctctcagaaggaatgttatttacttccttattttcttccacagccgggactgcgcaggggtccaggtctgttcccacagcgtgttttgcccccagcttcagggccacaatggaaaggatcccgctcccggttcccacatctaagagttctgtctcaggtgtcacatatttcttgagctgacggatacagagctgtgtggtttcatgcatacctgtgccaaatgcggtacccggatcaatgtggatgatcatgcggtccttatcttcctcttttacctcttcccaggaagggatgatcaggatatcgtccacatagaactgtttgaaatactgtttccagttattgatccagtccttgtcctctgtctgggaggtggttatggtaccctcaccgatgtccacaaaattgcgaagctctgaaagctcatccttcaccttttgaagcatttcctccacattctcatcctcatccagataaaaattcagatatgccacgccgtcatcctccggcatgtccggcaggatgtccacaaacatctgttttttatcctcctcagtcaggggctgtttatcctctatctccgccccctgaatgccgatgtccgccagtgtggatataatgatatcctccacgtcggttcttgttttcagtgtgaatttattccatttcatatattatattctcctttccggctgcgtttgcagtcagtgaaacagtcctgcctgtctacacaaataaaaacaccagggaaatcgtggccgccgagagcacggtcgacaaaatgatcccctcggaaatggtggttgtttctttcccatactgttccgccatcatcatgggcatattagccacaggcagagacatcatcagcacaacggaagccctcatgatatagtccggcagaaacggttttaacagcagggccagggctatgggcactgcaataaaacggacagcagtaaaaagcagaagccttttatttttaaacacactgcccaggttcattcccaccagagacattcctatcaccagcagggataaaagggtgcaggcattgccgcagtagttcaccagtgactgcagatctgccgggatttttatattgaaccaatagataatgaatgcaaggatgcaggctataaatcccgggctgaagatatcagtccaggactgctccaccccatccacgccttttttcacaagcatgattccaaaggtgaagatcaccacattgaacagaaagttaaagacgatcacatacaccatggatttcggccccaacaccgcagatgccaccggcagtccgataaatccaagattgccgaacacggtcatcagaatatatgcctctctctgggaaacaggcacccgcaggatttttgtcagggcaaatcccaaaattatgagaaaagcaaagcagagaacaccgatcagggcaaccaggcctacgttttttctagatatggaggtcaggtcgctgaacatgctggaaatgatcaaagctggggagcagaggttcaataccagggctgacatgtcctttgatgcagcggaagatatgattcgtctcttgtgcaggaaaaaacccgccatgatcaacgcgaatattattatcatctgcttcattactacaagaccgctcattttcttattcactctccgcttttgtattcaatattcctattatatataaaaaatttacggattgcaatgataaaagggggcgattttaagaatcatggagagggggacggaaacagggccggaaggggcgaggcggtctatttgcagccgctcgacgtttcagaacctgtgaactaaccaataactgcgactaagacggtcaccagagggttcccgcctaagtctccgtaattggtggatttcacagaaccttccacttaacctcgctgctgcaaatagaccgcctcgccccttccggccctgtttcctggttttctatggcggaaaatatttttaaaaaaataaatgagctgccacataccagtgcggcagctcttcaaattatttattttctttcggctgttctttcggctgttcctatggcctttctgcacagaagaacagtaaagaattggaatacagtgagaaggagcaggcttgccagttgtgcctgtaatgcaccgtggaaaatggtgttgatcacagcaaaagcgaaaagccccacacatcttcccactaccacaaacacctcgtgaaatgccagtaattccggtgtgtactgctcagcttccggtacactttgggacatgtcaaaaaaggtggtatagcaggatatctctatcattcccgcgaaaaaagcgttgatgacagcaaacgccaccaccattaccgggctgacggcccagaggcttagcagagaaacgccggtcagtacgcagatggcgcctaccatgtatttctgcctgttgtcaggccgtataaaatggctcataaaccagaaacacagaatagaagccgctccgctcaaaaaagaattgcaaccgatcagaaactcgtttttcaccagttggtaaaggatcatgttgaggataaacataaaagttccctcacggacacctttcatggtctcccccagcaggccatagagtatctgacgtttttgacagatcagccgcaaaaatttcaggtaatgtactccgggcttttcccggtgccgggtttcatttggcagacggaaaactgccagcagtgttgcgaaggctaccataaaggctacaataaaaatagccacatagccctttactcctccgatcagagaaatcaggcttcctgaaaaaaggggaatcagcagattgaccgcagcgctgaaaatactgatgatccccattccgctgtctctgttccaggtctctgtacaggacaggatcatccttccatagctgatgtaataaaatccgtctgccatgccgttagcaagcccaaacagcatgtaatactgtcccacctgatcctgaaaaaggatatagcaaagatacagaaggttatatcccagaataccgatcgctgccgttaccttgctttgtgtccagtgcatgatctgggcagataagagcatcatgaccgcgcaggccgcaaaaatcgcgccattgtaaaacagagtggaattgatgctccctgtctggttcatcagcaaagtattgataaaaattccggggatcctggtgaataccaggaacagtgtatgtaccagaaggaactggtagtaatggtgccccagagcagttcctcccaacacatatttgatctttctttttatgctgtgttctcttttcactacataagtgcctcacttagccaatgcggctaaaagcaaataatcttgctgttttgggttccaatttgatacgaagacactctgtctctgattcatatttgtgatctgttttcatatccacgggatacatacacctcacatcttttatctgacagcccttcttatgaagggggatacaaaactctttttccccttctccctgggttctccatacagccagatagcacctgtcctggcactgcattccatagctcaggtattcgtctgaaaaggatgcaagccctgtgggccagaagggaaggccttctttgatatcttcccgtatctctttatagcagcgaatcccatccgtcacccggcgcatcctgccctctcctatctgtcccaggtacccactctggtggatgcgcaggagcatggcattgaccatgttgaagaccgcctcctcctctgttccctggatgagcggataagaccagatcgctgcctgttccggcgcacacgctgtagcgcagtttgctgcaatggctgccatcttgatataatctgtctgatccgtgacagactggatactctgccgggaaagcatggaatactccatccgcatgcctccgctgctgcagttttcgatgatcaggtcaggataggtttcaaacaccctgtcaagccaggccaggtaagcacggttgtgttccagcagtcccgcaccggcgctgtccgcatcccggtctgtccccacaccgcagtctatgttatagtccatcttgatatagcctaccccatattcctccacaagacgtctgatcacgcccatagcgtactcctgcacctggggatttctaaaatcaagctgatatctgcaatgatcaataacagcctgcccgtttctctggaaaaaccagtcctttgacaccttatccaccataggacactttgttcccatgacttccagctccagccacaggccgggtatcatatcacggcttctgatatattgaatgacctcttcgattcctcccggaaacctctttttgctggggagccactctcccacgccatcccaccaatggccgtcagaataccacccgcagtccacacagaaatactcacatcccgcctctttggcggcgtcgatcagcggttttaacacatccgttgttggatcgcccatcagacaattcatatagtcattaaaaataaccggaagtgtttcgttatccttattctgccttctgatccttcttctgtactgtgtcatggcacctatactatcctggaattctccttccgtcacagcaacggcacagggtacagcggcaaagctttcccctggatgcaggtttatcatccagccgttctcctggaaggttggtcctgaaatctggagatacaactgttcccgaatatcgctgatctcccagtgccaggagccgcttgtctctatctcccatgtcatggatgtgtctgtttctgtgttgtaataacagcccatcggcaggaattcgtcacatccccagcttcctgtcttgctgtaggaaatgcgcttcattgaaaaggtattcacaacgtcatagcccagttcattcagcgtatattttttccactgtgcctccccaaaccaggtattatgaggaacatagatccatgcatttttatctctgggctgttcacacccaactgaaagacccgtaaaggcaaaggaggacagatattccaccgaatatgttttctctccttggttcttcagctcgttccagcatctcacaacaggaatgcccctgtagaactgcatatgtgtgatcagttttaatccctcatagtcctgctgtatctccagttttcttccgtattcattctcatgatccgtatgcgtctcatatttcataagcagggacgggctgctgcccgtatgtttatttccgtgatggtcacactggtcaaatccgctggcctgcatctccgccagagtatagacatgcaggtcctcctgcgcaatggcctccttctgcggacagcgggaaaaatgagtgaaggctgccgcctttcctttttccagtaccaaattcatataaatgccgttttcagcaatctgcattgttgttttctccttttatctgtaaattattggggccaaagccccaggcggaaaatcatctggatttccccctgtgatcctgccatatgtcagcccttgatccccgtctgggcaatcccttcgataaactgcttctggcataaaatgtagatgacaagcataggcactgtggcaatgacactgcccgccatcatagcccccttattggtgtggcacacgccctgtagaacactcaggcctgcggaaaggggcatgtgattcagatcattattggcgatcagaggccacatcaggtctttccaggcaaacagggctgtaaaaatagccagggaggcaatggtcgatttcgtgatggggaccatgatctttataaaggtctgccacggattgcagccatccaagatagcggcttcttccagttccttgggaagtgacatgtactgctgcctgagcaggaaagttccgaacgcactgaccaaagccggaaacaccagggcaaacacggtattcagcatattgatcttggacagcatcatatactggggaacaatgaagatctgtcccggcaccatcatctgcagcagcacgatcccaaacaaaaggttcttaaaaggaaagtgcatcctggcaaacccataaccggccatactggaaaaaatcactgcgcacagcacacggcctgctatcataagcagcgtattgccgtacagccgcagaaacggcactgcgtccagagcctgccggaagttctcagtatttttaaaactggacggtaagatctgcatgggtatcatcatctgttcccccactgttttaaaggaggacaaaaccatccagaagaatggaaaaagcataatgatactgcctgctatcaaaattacatgtgtccctacatgtatttttttctttctctgcatacttttttcctcctaatcgtaatgcaccatttttttctgggccgcgaactgtactgccgtaaatatcatgatcacacagagagcgataatagagattgcggaagcatagggcttatcctgtaccacaaacgcctccctgtaatactgaaacatgattgtccgtacagagtccatagcttttgatgtattgttcccgtacagcatgtaaataagatcgaactgagtcagggaaccgataaatcctgttattgtcaggaaaaatacactgggtgaaataagcggcacggttatcttaaaaagctttacaaagccattggccccgtcaatggccgccgcctcataatatgttttcggcacgttggtaatagccacgatcaaaataatgatctgctgtctcatcccgccccaaatggcaataatgacaatggacagcatggcatacttgggatcattgagccaggagtgggtttggaatcccaaatttcccagaagctggttcaaagctccaaactccgtattgtaaagccaggaccagaccatggctactgccgcgggagctgccaccataggtgtaaaatagatcacccggtacacactggtccctctgatttttttactcatgagccatgccagcagcagactgataaatatccctcccggaacagacaacgccgagaataccaaggtatttctgagaccgatccacacttccctgtcctggaatacccggacataattctgaagcccggcgaatatatattcatcaaagcctgtactctgggaaaagctgaggatcattgtcttgataatgggatagatattcaggaccagcaggccgatgatcgtgggcgcgataaagaaatacccccagagccatttctttacttttctttttttcatctcttcacctttcatatagaacggagctgcccagcacccccggccgacggcagccccgttatcagagtctatttttcttttgcaagtatctcattcatttctttggacgcgtctgtgaacccctccgcgggagagatctctccatttaagatttttgccacatagtcgttcatcactgcctcccactgggattttgactctgtacctacaaactgcacaccataatcaaggccttccaaaataacttttgtatcgtattccgcttcatgtgccttgctccaatcttcttccacaccgtcaaatgccgggatggcaggaccgtttacggcatccttcattccctgttcactgctggcatatgccacgaatttcttagccgcatccatattcttgcagttctttggtatggacagagcgattccgttactctgagtcgctttcacgccttccggtccggccgggagcggcgcaatggcgaacttgtctttcatgatctcattgtccgtataattgttcaactgccagtttccctggaactgcatggctacagttcccgttgcaaacatgctgatatagtccacttccgcctgcatttcctgggatggagaatactgctgcagctttacgaaaaagtccatggcttcaatggattggggatcatccagacctgacacattgtttgcctcgtcaatgatgcatccaccgttctgatagagtaaatttccccagctctcctgactgttattgtacgcgttaaatccatatatccctttttctttgtctgtgagcttctgtgcagcttcctctaagtcagcccaggtccatgaatcatccggatatgccacccccgcattgtcaaaaatctctttattatacaccagaatcacgcagtccttatctttcggaacaccgtagtgcttatcctccattgtgaaaagcttggtgatgccctccggatagttgtcataactgaatgtatcatctatctctgccagatcatcaagctgctccagcttatccccattcacatatttagcaatggtattggtatgcatggttacaatatccgccatgtttccgctggtggcggctgcctccagttttgtccagtattcaccccagggagtggtctggatttccactttgatgtccggatataccttgttaaacccgtcaacagtagcctggatagagtccttctggttttcattccacgttacataggtgagtgtcacgccgcctttactgccctctgttttctctttttctcctccccctgcatcgctgctgcctgtaccgcatgcgcacagagaacctgccataagtgctgctaataagaaactgccatactttttatttttcatgattcttctcctgttcctttgttttgattttttgtttttctgatacctgctgtgcacacacggtatattatgtatttcctgctgcttatgtatggaattataatattgtagcctcactttttactacctttaaaaattgcatattgacaaatgtgataagctattatctatgacatacttttgctttctcaaatgatatatttaaacaaaagagctttcgttaatttgtatatttttatataaaaggagaggataagaatatgaaacatgaatataaaatcctagatcctgcaaatattcttttgccggaagagatattttatctcaatctgacccaccatcatatggaatatcatgtacatgccccagggtccatcgaattaaattacattgtagacggagaatgtttctatgacattgacggcgaaattttccctgtcaaaaaaagaagtctgatcctggtgaatggacatattccccacaagctcatctgtacatctccctgtataaacatgagtatcaactgttatcagcatacgctttcgcccaatcttggtacactgcatgacctgaccacagcttatccggctctggcctctatttttgacagcctgaaaaccggcgttatccttcccaatgccaagaatatatatccgctgatgcagatcatcttcaatgaattcggacatggcaaagacccttattatatgaatctgatgctcaacaatgtgcttatcctcatacagaagcagatgtccgccacggaacccacaccggcacagacttatgtggaaaaggtgaagaattatatccattaccattatttcagcataaaggatattgacgaaattgcagactttgcagcattgaacaaggtctatctacagaaaattttcaagcgagaaaccggcacaacactctggaattatctcacccagttccgcctggataaagcggcttatctgctgtgtaattctgacatccccataggagatattgatgaaatgataggaataaattcaagacagaatttttatctcctgttcaagaaaatatatggcatgtcgccctccgaatacaaacagatccacaaaaaatcttaaagtgtatttgaatggcaggctctaatgctgcgcatcatcttctgattcccctaaatttatgcggatataaaaagcagagacataatcctttaaaaagattatgcctctgctctatattactaaaataatgatttacacactcagactaagggcctatgcctcctcgtagctgacttccatatgaacctttccggattttttccgaagaattgcatatgcaaggccaaataccagtaccacaacatttgcgataaattcccatggcttcagatcactgaacagaagtgttgtctgcaggatcagagagataccgcccacaacagcccagaacatcaacatgccattgctgacatggaattttgatttattccacacatcgggaatcttcttaaccatattgtaagaagtaaatgctagtattgcaaagaatacgttgttcagaataactgccatattgccgatcgtagagatcggaacattgaacaggataacgatcacacattccacatagaacatagtcagaatgactgtaggtgtcttatattttttatggatagtcgcaactttaggcgggaaccaaccgtcaaccgctgcctgcaggattggctttgtaacccagccaagggcagagttcagggttgtggaaagtgcgaacatggcaccgccgacgataaagaatacatgcagcggatacggaagcacttccgcggataccagtgtcaaaggctgattggcaacttccgctaccggaagaacgccagacgcaaccactaccagacccgcatagaaaacagcgataatacaggtagccactatgatgacaaaggggatatccttggtgggattcttacattccgcacctagatggataacaacatttgcccctcctacggcccaggtaaacagagcacctgcggacagcatagattttacgccgtgagtcataaactcgggttgttcaaaataagtgggtgttacatggggcagaccgaatacgataaatgctgtcagtgccagaaccatgatcagcatcattgcattctgcagtttggccgctccctcaatccccatcaggtttgtaatatagaagacagtcagtacaatgagagctatgagctgccgtacaaaaccattggatgccagcgccgggatcagacccagcatataatccgcaaagctcaaagcatacatagccagcgctgtccaggacaggatatgaacgataacaaagaatcctgcgctgacatcatttcccaaaagtgcaagctgtgtatagaaaccgcctctcagacgaaccgtacctgctacaaatatcaatggaatattggtgaaaattgtaaatatggctgcgatcagcatggaaacactggctgaccttcctgtcatggcaataccgatacctaccatggcaaaaataccagaaccgatcgtctgaccgataccaatggacagcagttcttttctgcctaaaaccctctttagttctttggttgatgcaacttcagacatatattccctcctcttttatacaatgccttttacacattactatttcaaatagacacaactgcactttgataaatcaaaaagcgtacagactcccctgtgtaccacccatccgggagagctttacgctccccgggggcagtgcattagaaaagaggttatgtctatgtcctgccgttatgcgtttttccctgcaaaatatccgccgcttactgcctgcaggatcttgcccggcttgatacagtcgcccacggtgataaactcggcatcgtttgtgcgaagcttctccacctcgtcgatctttgatctcatacccactgacaacaatacggtgtcagccggatagatcacttctttgccgtctttgtcctttgcatgtactccgtcgtcctcaatagaggtaactgtaacttccgtatacggatgtaaattctctgtacgtttctcatattccagcatcatggctttcagatgcagaaccggtgcgtcgggagccagtttctcctgcatttccagaaccgttacatcttttccttccatagccagggccaggccttcttcacatcccacaagaccgccgccgatcaccactaccttttctccaaacttcagatccggatcacggagctgggttacttttaccacattatctctgtcaactcccggaatcctggggataataggctctgcgcccactgcacatactacagtgtccggtgcgatttcctggatcagttccggtgtagctgtggtattcaggcgtacctggatcgcttttctttccaccatacggatcagatactgcagatatctgccaagatcctccttgaaggatacatcgtgaacagccacattcagcataccgccgagacgatccgctttttcgatgaggatgacttcatgcccctgctcctcagcttttaatgctgcctgcataccgcccgggcctccgcctatgactaatactttcttaggctgtggtttcggctgatacatgccctcttttaagtcgcgtcccacttccggattcaccacacactgggaaatgccggaacacatatctacatagggaacgaaatccagtgacaggcagtgattacatctcacacagggacgaacctcatcaaaacgtcctgcttttgccttgttggggaattccggatctgccaggatctgacgtcccacatagataacgtctgccttgccggatgcgatgatgtcttccatctctgccgggtctgacagggaacctacggttgcgatcggtgtctttacatgcttcttgatggcttctgccaaataaacattgacgccatggggcaggaatgctgacgggaacatacggcatccggagtttacatcacggaaggaggtggctgatacatggatcagatccactttgccgtccagcatcttggcaaactcaatagcgtcatcaaggccgtaaccgccttccatgaactcatcacctgagatacggatctcaatggggaagtttggcccaacagctttacggatacggtcaatgaccataagcgggaatctggcacggttctcaatggaaccgccgtatttgtctgttcttgtattatacagcggtgataagaattcgctgagcagccatccgtggccgccgtgaaccatgaccatatcaaatccgccgaattttgctacataagcaccgtgtgcaaaggcatccgcaatctcgttcataatgtcttcgtccataggtgttacatccacaccgtatacaccgggctgtgcgctgggtccatagatgatgccgttggtatactgaggatgggcacgggcaccgctatgtaaaatttcgatattggccagtgcattgtgctgatggatcctgtctgtgagctgcagatgtgacggcataaatccctcattgtccagattacagagattgccgtgagcgcttcccgtgtgggcatggaccaaggtctcgcctcttgtgacaatggcagcgccgccttttgcgcggttctcaaatgctgcaaggttctgttcggataaaaatcccgatgtgttaggttctgatcccataggagcagttgcaatacggtttttcagagttacgtttccgatacgtaacgggctgaataaatgtggatagttagttgacataatagcacctcgtttctttttaattggtatatattaattgttgtaataccgtgtcaacctttctgattggcttatattgatactagcataaaccctgcgtataatcaatatcattttatattttcagcattaaagtaaattttattatatattttttgtgtatttttcacatacaatcacattactacctataaatcaatatattccaatccgcaaattaatatattccaatttcccattgtcaaattgagctataccagttttgtatttgatgaccttcactgtttacaacatgtatattctataatccggaaaaaagaagacctgtcctgagattcaataagatttataaagaatttgtatgacgcatattatcgttttcgtgttgcctgtatagataaaaaacgaaaaggatgtgcactgatatccgttgcacatcccctctctgttccgtctctattttatttttaaatatataatcagttccaactctatattatctaaaacttgatatagaaaatccgatcatccgcataaatacaacactttaggactattcatgaactaaaaaaataactattttaccacgaatttaccatgattgaatgggccttgatatgacagaaaaagagaaagggagattgtacaaaaacgtgtatctccctttcaattctattattttctaagttattcccagtccatagccacacacgcatataccgcagtttcgattggtaaaacttgttcattaaaacatactttcggattatgatgtgtataaataatatctgaatcgaccttagctcctatcaaaaaataagaagctggcactttatctgcaaataatgcaaaatcatcagaacccgttgtgtgcaacccagataccatgttaaattcggtattcatagaacttaacgacttagcaatttccatattccttttttcatcacaacagagtacgggtatatctgttaaaacctccaccttgctttctgcatgaaaggcatgagaaatattattaacaatttccttaattcgcacaattaaatactgttttatttcattatcaaatgtgcgaagtgttccttgtaaaatagctgtttctgggataacattgcttaccgttccagaattaaattgcccgattgtcaatgttacttcttggcttggagaacactcacgtgcgattagctcctgcaatgcttggtaaatatgaaccccgacgttgatagggtctattccgttctggggcatagcaccatgcgtaccctttcctgttatcgttattttaaagccaaagacagatgttcctgtcatagttccataagcaattgttcctacgggaatgacggaggctacatgagttgcaaaagctgagtccactttaggattttccattgctccctcagcaatcactgcgttagccccctcaaatgtttcctctcccggctgaaacaataactttattttaccttttaattccttttcgtgcttttttaatatcttagcagctcctaacagcgcagtcgtatgtatatcatgcccacaagcgtgcatattgccattttgtgaagcaaaagacaattggctttcttcattcataggcaatccgtccatatctgctctaagaagtaagcatttattcccagagcctacatagccaataacacaatttccattgacctttgtttcaaatggaatactaaattctgtcaactttttttccacaaaagaaacggttttaggaagttcaagtcccaattcaggtatttcgtgaagttctctacgccattctataagctcattatacatctctttgctttcagcataaattgaagaatacatattctcactctctttcttggaatttttacaataactattttacccctttttcacatgtttgtcttgaagtataattttatatctgttataacatatacattatagctgaagggaaattaaaatatggaaatacatcatttaaaacaacttattaccatttctcaatgcggttcaattaacagagcttcacaaagactgtatatttctcaaccctcgctaaacaatattgtaaaacgatgtgagaaagaactaggatttacaatttttacgaggacaccaaaaggtgtaaaattaactgaaaaaggagaggcatttatcaaaatagctcaaagtattattgcagaatataaaaaaatagaagacttttcttccactaataaaatgatttctatttcatttatttatttatcatatattcttgaagcactccttaaatttcaagaacagggctttttagtttctgatatgcttcgtaggacagagccgtttgaaacaataaatgatgttgtatctcaaaaggttcgtataggaattatgccagtatatcaagcagatttaaacgaatttgcagaggaaataaagcaatatagtttgcagtatcttatgctttttgaagacgtacaaatatacgctattgttagccggactcattcccttgctggtaaaaaaagtatttctatcagtgaagcccttgaataccctttaacttattatacagcagtacttgaaaaatctgtgcttagaaatatatttgactctaagcgttctctaaaagtacagaatagagacgaattatttttagtactgaaaaataataaacatatttcttttttaacccttacatcccattcaaaaaatccggaattttgttatattccgataatagaaaatgagttcaaaatgaatatatgtgcgatttttctttctgatactacacttactaagcaagaaattgagctggttcaatttcttaaaaatacagtacatttcatataatttaggttttcattcaagtctttgatttgaatgaatatacaagcaatttcattaagatttcagatgtttgaattatgttgcatatagacagagttatccttatttcctcttgatctgggcttttgtttgctgtatcttccataaagaggaaaaagttactcgttctcatcattaaaacgactattccttaatacttcccgtaacagttccatatcttcttttgatttcgggtttatcatttttacgacttgataaggtgttttatatttatgtccctctgtgctttccccgaacatatccatgctgtataaatcatcatagcgatttaatacttctgaagttagccattcttcctcactgtcaaagaaattgtcacaatgtccatgtttcagttctacgttttgtcgtggcaaacaggaatgaaagcaacaagagctgttggaaaacgtgccgtttctggcaacgctttttaggggctgtggaactcttaaaactccatgcccccacaccgcacaattccctctgacgcggcagcctcatccagccatcttttaaaaaccagcccccgcaaatggtacaaagacccctgatctgcatattgatgaaaaagaaagctgcagattccctttttttcacacagaagctgtatttctcttataagtccgtctttgtaggaggggttctgcggcagaatgaccgcctgataccggctggtattccgctccagttcatgtatggtattcttgaccggaatatatgcataagggctgacaacgccaaattctttcaggaaacattccacactgaaacggtaccattcacctccgtatatgacggcaatgggcttttctccccggagttttgcaatgttgctgatagtctcattggatacggacagaaccaccttttccacaggtattctgtctccgccttctaccacatgcttcacagttgcccacacctcatcgtgatgattgatcgtggtagcgaacagatcatatttttcccggtttaatatactcgggtcttctctgatctcatctatgaggaaggaatctgcatggacattacagaaggacgcaatttcctcggctgtatcctgcaggatttcctcactgcagtctatccaggcaagcttcagacgctgtctgtcagggacatgtctccaggcactctccataaacatccgctctatctctttctgccccttgcccatggatgccagcttttctatggtttcatggatcactttgcatacttttctgtctatatctgccctacggctggtgtccacataggttccgctgccttttttggtagctgcatagccttcccggcacagctcttcatatgcctgcttcactgtgttgcgggccacgtgcagatcttcactgagtctgcgctccggcatgagccgctccccttctttcaaagcgccgctctcaatctctgcgatcagcttctgtgcgatctgaagatatacaggtacctttccgctttcttctaatgtccagttcatatttctccattccccttctgtctgtccatcttagtgaccacctccaccatgtgcatccaggacccctggtcaatctcatattccatgggaatgatcctgcatttactttttcttgccctggccaccacctgcagcgtccacgcgcttgcatattctatgtaatcaggcggaatgatcaatggcattccctgtctgcagcagttgtcaatggcctcactcatctcttcctcactggagcagatttgttcattcatcttccccagaaaatgcagagtcctcttgatattcttcaaaaatgcagcgctcctgtacaagatgcagacaggctgctcctcaggaatggtggccagccttgcgatcgtctctctgctctccacaagcgcaaaagtctcagttggaatacccagggcatctgcatacccaataaactccttataatggctctgtgagataaatgccagatcacagcgggaactgatcacccggtttccggtaagcagatccgacaacacatatgtttccaccgtcagattagggatggattccactaccggagcaatggaatgcagggtctcaacattgcactccaccagcgccgcacagattttctgtttttcctggaaacggctgaccagttcctgctgtgccagaagaaacagcctgttcatgggcataccactttctgacacttttgaaaacatctcctccacaatttcagaaggacttttctctttcccctgtacgttcccggatttcttctcctgtacataggctcccccgccgcggattttctgtacaacgcccctgtcctgcagccaggcatacgctttctttacagttcccactgacaatcctgactcatttgccattttgatttccgataaaagacgttcccccggaaccagaatgccgtctgctgcctgctgttctatctgccgggcgagctggagatacagcggcgcttcaccgtttttatctatctcaattttttccatctcaacaaccttatacttccttttatctttcttccatttgttgataactgttccatattctcacagttacgaacaaaatccatatcgctttatccattgtaccatatcccttccggtaaaaaaagaggtactgcccacggtaagctttctcttgacataaatgtgtaacggggcatacaattgttgcatatacaataattggaggtgcaattattaatgctgagacgtttgttttcctatatgcatcagtacaagaagttcgcagtccttgccattttctgtgttgcggcggaatctgtttttgaattgatcgtccccctcatcatggcggatttagtggatgtgggagtggcagcgggtgataaggattatatctacatgaaaggcctgcagatgatcatctgcgctgccatagccctgatcctgggaatcggaagtgcccggttttcagcccttgcgggacagggactgggggcagagcttcggaaggcggaatatgaaaaactgcaggggtattcctttgccaacatagatcatttccgggtatcttcactggtcacccgccttaccagcgatgtgaccaatattcagaattccgtctccacagggctgcgtcctttctgcagagggcctgtaatgcttgtggcagccacgggagtggcattttctatcaacaaaagcctggccatggtcttcctggttgctctgcctgtattgggaatcctgctgttcctgatcatttcccatgtaagacctttgtacacgaaaatgcagggtgccgtagacacggtgaaccggatcattcaggaaaatcttattgctatccgggtcgtaaaagcctgtgtgagagaggactatgaaatttcaaaatttgaagccgggaatgaaaatctaaaggcacagtccgaacacgctttccggttagctgccctgaatatgccggcaatgcagtttgtcatgtacggaaccattttaagcatcctttggtttggagggggattgatcaaaggcggccagatgcaggttggcgagctgaccggctttcttagctatgtacttcagatcctcaattccctgatgatgatatccaatgtatttctgatgctcacacgttctatggcatccgggacacgtattttagaggtcattgatgaaaaaattgatattacagatgataatgcccaggatatccaggtcaaaagaggagagattgaattccagcacgtatggtttaaatacaagaaagaggcaaaagaatatgtgctctctgacatttccctccacataaagcccggacagacggttggcatcatagggcagaccggagccgccaaaaccactctggtccaacttatccccagactgtatgatgtggaaaagggggttgtcaagatagacggtattccggttcaggaatacccgctaaagcacctgcgcgatgctgtggctgtggtcttacagaaaaacaccctgttctccggcacactcctctccaatttaaagtgggggaaggaagacgcctccatggaggatgtaaaggaggtctgccggatcgcctgcgtagacgaatttgtggaacggctttcggatgggtatgagacagagatgggacagggaggcgtaaatgtttccggcggacagaaacagaggatctgcatagcccgggcattgctgaaaaagcccagagtattgatcctggatgattcaaccagtgcggtggacactgccaccgaagggatcatccgacagcggatgcaggaatttcttcctgatatgaccaggatcatcattgcccagagaataacctctgtaaaacacgctgaccaaatcattcttctggatgacggccgtatcagcgatacgggaacccacggggaacttttacagcgaagcgagatttacagacagatatatgaatcccaaaaggaaggagtggatctgtaatggcaaaatttgtaggatataaaaggcccaaaaacaccaggaaaacattgctgaacctctttcgttatctgggaaagcataaatggatgtttctcctagtcgccctcctggtactgatcagcaccggcgcaaatatcatgggaacctatttactgaagccggtcatcaaccaatttattctgcccggcaatacttcgggtcttctaaaagcagtggcagccatgggcgccatgtatggatgcggggcactggccactctgggttataaccagttgatgataaaatccgcgcaaaaggtgataaaggagatcagggccgatctctttgcccacgtccaaaaactgccgcttcggtattatgatgcccatacccacggtgagctgatgagccgctttactaacgatgtggatacagtccaggaggccatgaacaacagctttgccatgataatccaaagctttatgatgcttacgggtacggttgtcatgatgatggtacttagcgtgaggctttccatgatcgtggtatttttcctttttctcatgtttatgtttatcaaatttaacggaagtaaaagtaagaagtatttccagagacagcaggctgagatcggaaggatcaatggatttgtggaggagatgatggcaggacagaaagtggaaaaagtatttaaccatgaggaaaaggacttccagactttctgtgaaatgaacgaatcactgagaaaggaatcctcaaacgccctgacttttgccggtctgatggtacccaccattgtaagcctgtcctatgtaaactatgctgtttctgcctgtgtgggcggtcttttcaccgtattcggcatgctggacatcggaagcctggcctcgtatctggtctatgtaaggcagagcgccatgcccttaaaccagtttacacaacaggtgaatttcttattgtcagcgctgtccggcgcagaacgtatctttgatatgatggaggagcccccggaaatcgacgagggagaggtcacactctgtaatgtggagacagatcacgacacactgaaagaatgcagccagcataccggacaattcgcctggaaggttccaggagaggcgggtgctcatctggttttgctgaagggagatgtcaagtttaaagatgtcatattcggatatgaccaggaaaaggtcattctgaacaacatctccctgtatgcaaagccgggacagaaaatcgcctttgtaggctccaccggtgcaggaaaaacaaccatcattaatcttatcaaccgtttctatgaaattcagtcaggcgtgatcacctatgacgggattgatatcaagaggattaggaaggacgatctgaggcgttcccttgcaatggtcatccaggatacccatttattcacgggaaccatagcagagaacatccggtacggaaatctggaagcagacaacagtgaaatccatgaggcggctgtgatcgccaacgcggactccttcatcagaagactccccgaaggatatgacactatgctgtacagtgacggaagcaacctgtcccagggacagcggcagcttctggccattgccagagccgccatagccaagcctcctgtattgatcctggatgaagccaccagttccattgacacccgtacagaacggctcatagaaaaggggatggatgccattatggaaggcaggactgtatttgtcatagcacacaggctgtccacagtgcgtaatgccaaagccattctggtgctggaaaagggggagatcattgagcggggcagtcatgatgagctgttggagcaaaaaggacgctattatcaattgtatacaggacaatttgaattggagtgatgaaaatggaaaagagtaagatcagagaaatcctgcacagcctggacatggagcgcagaaaaataataaggccaaagttccaggaactgggcctgaccgtaggcgaagggcaggcaaagatcctgaaatgccttctggagcagggaagcatgacacagcgtgagcttgctgacagatgtatgctggatgtgacaacaatgtccagaaccttggacaaattgcagggggcaggttatctgctcagaacagccaacccctcctgcagaagatcctttcttatctgtattacaaaaaaaggggaagaaaaggctgcctgcgtgcagaaaatattttccgctctggacgaacagatctgtcagggaatatcagaaaacgaaatggaagcgctttatgatactttgcagaagatcatgaacaattttaaaagtgaatgaggattccatgggtcatgggcacatatccgaaattcaaatgtaactgccataagtcatcgacgcactccaaaagaaggcactgcggaatcttttccacagcgccttctttgattatgaatcctcaaaagtctctttcagtttgtccatgaatccttttttctttttctccgtactaccggctggccggttgccgcaggcctcatcaaattttctcagagcctctttggcgtcctcattcagcttggtaggcacttgcaccaccagagtcacataatggtcaccgcgtacgctcttatttctcagagacggcacaccctttcctttcaggcgcacttttgtgtctgtctgtgtaccgggcttcacatcatacatcacgtccccgtccacggtactgatgcgcacctcaccgcccagagcagcctgtgcaaatgtgatgggcgccgtagagaatatgttcatatcctgcctctggaaaatcggatggcgggatacgattacctccaccagcaaatctcctctcgggccgccattggttcccggttcacccttatccctgatacggatactctgtccgttgtcaatacctgccggtacagatacctggatcttctttctctggttcacgtatccggttccacggcagtccgggcatttgtccttaatgaccttaccggttccgtgacactccggacaggtctgtacatttctcaccatgccgaacatggactgctgggtgtataccacctggccttccccgtggcatttcggacaggtttccggagaagttcccggctttgcgcctgttccgtgacatgtattacagttttccttcagattcagatccagctctttttcacagccaaacactgcttcctcaaatgtaatgcggacggatgccctcacattggcacctttcatagggccgttgttggctcttcttcttccgccgccgccaaacagatcgccgaaaatatcgccgaaaatatcacccatatcagcgccgtcaaatccgctgaagcctccaaagcctcctgctccgccggcaccgccgttttcaaaggccgcatggccgaactggtcatactgtcttctcttatccgggtcactcaaaacgccgtaggcctctgtcgcctccttgaattttttctccgcttctttgtctccggggtttacatcaggatggtacttctttgccagcttacggtatgcgcttttgatcgtggcgtcgtcagcgcctttgtccacgcctaagacttcatagtaatctcttttatctgccattggtcttatccctttctaaacatacagtcaggcatggagtgctgtaaacaccccatgccatccaagtcatttactgacaaagctattttatacttctctgtagtctccgtcaaccacatcatcaccgtatgcttcatttcctccctgagtaccggcacctgcgtccggaccaggacctgcctgtgctccctgggaagcctgagcctgctcatacatcttagcaaagagtttctgtgcgctctccatcagtttgtctttgccggctttgatgtcagcaacctgagcatctgtgatctcttctgtatttgcacagctgtttaacagttcttttaatgcgttcagatctgcttctacagcagtcttgtcattggcatccagcttgtcgcctgcttcttccagtgctttctcagtctggaataccatagcgtcagcgtcattcttggtgtctacagcttcttttctcttcttatcctgagcttcgtactcagcagcctctctgactgctttgtcgatatcatcatcagacatgttggagcctgcagtgatggtgatgtgctgctctttgcctgttcccaggtcttttgcggatacattcacgataccattggcatcaatatcaaaagtaacctcgatctgcggaacgcctcttcttgcaggcggaattccatccagacggaactgtcccagggatttgttatcttttgcaaactggcgctcaccctgtacgacgttgatgtctacggctgtctgattatcttctgctgtagagaagatctggctcttctttgtcgggatcgttgtatttctctcgatcaatctggttgcgataccgcccatggtctcaatggacagggacaacggagtaacatccagaagaaggatatcgcctgcgcctgcgtcgcctgccagcttaccgccctgtacggaagcacccagagctacacactcatccgggttcagagtcttgcttggctctttgcctgtgagctgttttactttatcctgtacagcagggattcttgtggaaccgccgactaacagtacctggcccagttcggaagaattcaggcctgcatcagacagtgcacggcgaaccggctctgctgttctctcaaccaggtcatgtgtcaattcatcgaatttggcccttgtcaggttcatatcaaagtgcagaggtccattgctgttcatgctgatgaacggcaggttgatattggttgttgttgcagaagaaagttcttttttcgctttctcggcagcttctttcagtctctgcattgccatcttatctccggataggtctacgccttcggatttcttgaattcagcgatcatgtaatctgcaactttctggtcaaagtcgtcgccgcccagacggttgtcacctgctgtggataatacttcgataacgccgtcaccgatctcaatgatggaaacatcgaaagtaccgccgcctaagtcgtataccatgatcttctgctctttttcattgtcaaggccgtaagcaagcgctgctgctgtaggctcgttgatgatacgtttcacttccagacctgcaatcttaccagcgtcttttgttgcctgacgctgagcatcgttgaagtaagcaggaactgtgataactgcctctgttactttctcacccagatagttttccgcgtcacttttcagtttctgaaggatcattgcagaaatttcctgcggagaatattttttatcgtcaattgtcactctgtaatctgttcccatatgtctcttaatggaagagatagttttatctgcattggtaacagcctgacgttttgccggctcacctaccagtctttctcctgattttgtaaaagctactacggacggtgttgttcttgcgccctctgcattggcgataactaccggctgtccgccttccataactgctacacagctgtttgttgttcctaagtcaataccaataattttacccatgataaatttctcctaaatttaaaatcaattacttttcctgttcacagcggctttacgctcccgccaaagcgtttcatctatgagataaaatccaacggtctgtcccgccggagaatttgggttgcgccttcggcgcaccatctaaaactaattggcaaccttcaccatgctgtgtctcactacatgatctttgtaaaggtagcctttctggaattcttccaccactacattctcaccggcttcttcatcctccacatgcatcactgcattgtggtaatccggattgaactcctgccctactgcttcaatgggctttacgccgatctcttcaaagacggtcatcatctgcttgtaaatctttgtcataccgtcagcaaagggactttctttttcattttccggaactgccgcaagacctctttcaaagttgtcaacgaccggaagaatcttatcgatcacttcacgcgcgccgatttcatacatggaggctttctccttctctgtgcgctttctgaagttatcgaactctgccatctggcgtttcaccatatcggtgagctcttctattttttcatcttttttatcttttttcttcttgccgaacaagccttttttctcagatgacttgcctttcgtctggtcagcctgctcttctgtccggccttctgtctcctcatcagcctggtcatcatcttcacccggctcttcacaggtggcctcctctgccagcgccttatcgtcttcctctaagatttcttctgccttctcatcagaagccgtatccggctgcatctcttcatataattctttttcttctgacacgaatccgtaccgcctttctaggttttcttaaatatattgtctaactgcgtcttcagcgtttttaaattgtccactacattttcgtaatccatacgtttggggcctatgataccgatggttccctgcataccgcctcccaaatcatatgtggccgtcacgacgctgcagtctttcatagtcttaacaggagtttcatttccaatgtatacctgaatgccggtattttcctcggaattcatggtatctttgaccaaatctaccagttcctgcttttcctcaaaggcggaaatcagttcactggcttttgaggtatctgccagctccggatatttaaaaatattcgtggtcccgctggtataaatctccacctcatcctcatccaccgcaatggcattagccaccgcgtcaatgacgcttcccacaacagcgctgtggatacctgcctgttctttcatcttagtgatcatacccaggttgatctcctcaatggtgaggccgtttaactgggtattgagaagcaggttcagcttcagtattgtgtcatcatccataggctcctgaagggctatcatatgattcttcacaatatttccttcgatcaccagaactgccagaagctgcatctcagccactctggaaagctgaatgaattttaatttgtttctgtgataggtcgggccggtgatcatggtcgcatagttggtgttggatgcaagaaccttcaccacctgtttgagcaccttctccattttgtcggtccgctcgatcatcatttccttgatctccgaaacttcctgttccttctcccgcatcagctcatccacatagaggcgatagcctgcgtctgagggaatccgccctgccgaagtgtggggctgtacgatataccccagttcctccaggtctgacatctcgttccggatcgttgcagagctgagattcaggtcagtgtattttgaaatagttctcgagccaaccggttcgccggtctccagatacgtctggataatggcttttaatatctttcgtttccgctcatccagttcactgtccattattatctcctttctgcttctgcattgataaggccggtctcttttccggcattgttagcactcgtttgtgtggagtgctaacatctatgttctaaagatagcaccagcgtgtttatttgtcaagggctttatattttttttagaaagtttcagaatttgcaacaataatgaagaaaaagggacatgcaaaaaaacagaggggctgtctatacataacagcattccctctgttttgttatattatatcggaaatattagtcgattttcatttattcaatcggtacaatataaaggttgtcctcagtcagaatctgctcaccctcaggataggattttacgaacagaaggctctccacctgatccgggtccagtatccggtcaattccataggtcagggtatactcatcactgtcttccgataaatagccggaactgccgggtccccggtacaggtatagatatgtggttccgtcttttaattttactcctgtcagccacggcgcttcctcatatgtccgggaaacaatctcttcccctgactcattcacgcctttttcctctgtcagctttcttgggaaatcatataccactctcatggaaataggagatatttctacctgctttacagtggccccgctgtccccaagcacatagtccgggctgctttcccgtacctgatccgaaccgcccagggtccaggcaaattcccactcagcttctatgtccggtatataaccgtctatggtgatctcacccagattttccaactcaacactgataggctttccgataaagtatcccttttcatcttcttttgccaaagtgatctcatactccatactgccgtcttccagagcatatctctccaagattccatcctcagagattggagttccgtccgcatagacagctctgccgtcatttccctgcaccaatccgttgtaaaaggatctggaaatgctgaatcctccgtctgccgcatctttgccgtcaattttcacctgtacattttcaaaatccggctgctttccctgatcaagctcatagccctccaccttaaatgccagatgtacgtaatagttatccacaatactctgcattgccgtgacttttatcccctgggcacttacacttttgtccacaggtgacgccatattttccgcttccagtttatgcatttgatccggttccgctttcatcccctctgacattccgtgactccactgcatataggctgccgcccccgctgtgacagttccaaagacaagaagggccgcggctgcaaggacccatattttttttcttggcactttacccgttacttttctcattgccatactctcctcttcgtaccttttccgggcatccttttttatagaagcaaaagcttcctctgctttttgctgtaccctttccggaatctgcacatcctgtctgagtttttctaatatttcatcttctctcatactcatatcagtcttctcctttccgcctctggataatattcctctgccatcttctttctggctctcgctatcctcgtcctcacagtcgcctccggaatatccaggatttctgcgatttccgacattttaaagccttccacataatacaggacgatcacggtccggtatttctcatccaggattcccagggcctcattccattccagatcactgtaaccctcttcttttacttccacttcaggcgtctcgtctgtgaaaaaaagattttcctttttgttccttatatcattacatttgttgattaggattctggtcatccaggtacggaaatacctttcttccctgagctggtctattttctcccagcaggtgaggatggtttccgatatggcatctgcagcgtcctcctggttggaaagcagtgagcgggcagctttgtacatattctgcatctgggactgcatgagttccgtgaacgcatccgcatcccgctctttcgctttttttataagatcattcataacaggttcctttcttccgtacgtacgtttccacatgtttttcatgtttctgcttattagacaggtcatctgccggaaatgtttcaactgcctcccataaaattttaccgcatggctgcagacatggtcaggatggcttttttcctgacaacaaagcagccggcgctccacccattcccggagcgccggctgcttcttataccactgcttttctgttcgatactttattgatgataaatactacaataaccagtgccgccactgcaaatcccagagaagccgcactttttgtggctcccgcgattataaatgcagtcagggcaatgacaccgttgaccagcgcatagggaagctgggtcctcacatgctccaccagatcgcattctgcccctgtggaggacaggatcgtagtatcggagataggggaacaatggtcgccaaacagacccccggagagaaccgcacctaccgctatggcaaaaggtatggagaaagcctgtgccatgggtatagcaagaggcatcatgatcgcaaaggttccccaggaactgcctgtggaaaaggagacaaaggctccaaacaaaaagattgccgccggaaccagagccgctgaaaagctcatggacttcagcacatccacaataaactgggccgttcccagttcactgatcatacttcccagagaccaggccagtaccagggtaattgccacatctgtcatccccttcatacctcccacatatactttgaaggtctcactgaagttcattaccttgaaaagacagatcatgaggatcaggaccagcgccccgaaaaaatagcccatggtaagcgcaactctgaattcgttaccgtccacctttttaaagggaaagcctaaaggcgccagggtcgcgaacagggtgacaaataccactacaataggaaggatcaccatgatcggctttgcgttctttttagaatatattccggtactctcttcttcctccgcgtgttctgtaaaactgtaaccggctttttctttctctgttctctgctccgcttttttcatctgggaaaaatctatttttgtgaaagctatgagcggaatcaggatgatcgccaagatcgcgtagatctgaaagggaatcgcctggacaaaagtggtataatcggattcctttacacccagattgtcaaattctgactggataagtcccataatatatacgccccagccgataaatgggatcagaatcgccaccggagaagaagtggagtccaggatccaggccagtttttccctggagattttcagcttgtcaaacagcggccgaaacacaggccccaccagaagcggagttcccagatcagaaaagaatataataatcccgcctgcccaggcgcagagctgtgctttcagttttgtgttcacatagcggtatgcgctctgcccgaaagcctgcgcgcctcccgacttttccatgagcttgataaatcctccgatgaacacaaccagaacgatcacacccgcattataactgtctgtaagctgcacgaataaataatcaccgatcatggatttcaccgctaaaaacggattaccatggctgaagatcaatacacctgtaagccctccacagaaaagagaaagaatcacatttctgctcttgatcgccaggataacggctatgataggcggcagtaaacttaaaataccgtaattcatagttttcctcccaaaatatttaatattttcacataagaaaaggccttggctggatatcttaaagcagccacagtcctgtatttctgccccgcccagggacagtccatgagtaatattacattattctgaataaatttacaagaaatttattttatttccgccaatcaggtcctgagtataaaaaaatcctgcggaggaggaaaatactatcccggttttttccatccccgcaggtatctgatccagagtatatctgaaagctgcttttaatcgtcgaaatgatttttcagattttcagacatactccggcatatacggatcaatcctctgaaatctcctccagattttttctaagctctatcatcttatcacgcagctctgctgccatctcgaaattcagatccgctgccgctgcccgcatctgtttttccacatcctgaatcagcttcttcagctcttttttgttcatggactccgggtctttcatcagcttattctccgtctcagccacactcttggagatactgataagatcacggaccgccttcctgatcgtctgcggtgtgatgccgtgggcttcgttgtactcctgctgcagcttacggcggcgcatggtttcgtcaatggcaagacgcatggaatctgtcattttatcaccatacatgataacacgtccatccgagttacgggccgcgcgtccaatggtctggatcagggatgtctcagaacgcaggaagccttctttatctgcatccaggatcgcgacaagcgtgatctccggaatatccagaccttctctcagcaggttgatgccgacaagcacatcaaacacatttaagcgcatatcacggataatctctgtacgctccagggtatctatatccgaatgcaggtatttgacccggatgcccagctctttcatataatccgtcaaatcctctgccatccgcttagtcagagtggttatgagtatcttattgcctttctccacctctttgttgacttcccccacaaggtcgtcaatctgtcccgccacagggcgtacctccaccatggggtccagaagtcctgtgggccggatgatctgctctgcccgcagcagttcatggtttgcctcatagtcccccggtgtggcagacacaaacatgatctggtcgatcttgtcctcgaattcttcaaagttcagaggacggttgtccagtgctgacggcaggcggaatccatagtccaccagtgtgctctttctggaacggtcacctgcatacatgcctcgtatctgagggatcgtcttgtgggactcatctacaatgatcaggtagtcatccccaaaataatccatgagcgtatatggcgcttcccccggttccaaaccggataaatggcgggagtagttctcgatcccggaacagaatcccgtctctttcagcatttctatatcaaagttggttctctcggaaatcctctgtgcttccagcagtttgtcctcactgcggaaatattccacccgctccttcaactcctcctcaatattcacagccgccttgcgtatctgctcaatgggaactacataatgggaggccggaaagatagcaatgtgattgagctgggatttgatctctccggtcaaggtgtcgatctgggtgatcctgtcaatttcatctccgaaaaattccacccgcactgccatgtccgtataatctgccggaaagatttccaacacatctccccgcacgcggaaggtaccgcggtgaaagtccatgtcatttctgtcatactggatatcaatcagctcccgcaccacatcatccctgtccttttccatgcccggacgcagggagatgatcatgttctggtaatccttcgggcttccaatgccatagatacaggatacacttgagataatgataacatccttcctctcactcagggaggaggttgcggagagacggagcttgtcgatctcgtcgttgacggaggagtcttttgcaatataggtgtcggatgaagggacataggcttcgggctggtagtaatcgtagtaactgacaaaatactccaccgcattatcagggaacatctccttgaattctccatacaactgagctgccagtgttttattatgtgcaatgaccagtgtaggtttctgcagctgctcgatcacatttgccattgtaaaagtcttaccagaacccgtaacccctagtaaagtctggcattgattgccttctttaaatccttttacgagctgttcaatagcctgaggctggtctccggtaggcttatatggagcttttaaaacaaatttatccataacagatctctcctttgtgacttttgatacgttcaatatcagccacccttaaaaaatttattcgtaacgaaaacctcaaaataatagccttatgggagtcttttacgaatcccgaaaggcaaaagtcacaaaacacttttttgaggacaatataacacaaggtaatactaaaagattagtgataacattatagcaaacataataataaaagtatatagattcaaagaataaaaaagtacaaatgttcgagtatccacttgtactttttatcctcatttccttatgatattattgtgatcacgctgttagtatatattcctctgctacctcatccatctcttttatttcagtataatcgtaatatttttctctttggctttctggaaggacttctgttatgaatggttctatggcatacaagcaatcttcaatgatctccgccgtatctccataaatatctgccgaaataatttcttttgcatgtcccaacatatgcgaaactcctttaaggttaaaatcatttttcaagagaatggtcgcatatgtatttcttaactgatggaaatgaatgtctggcagtcccaaagaaacgagtagttctttaaagtatttatgatgataacttttacttctcggatttccgtaactggaacagcagatataatcccaatctctaaacacctttgatcttctccggcggtttttttcatagatacggcgttgttccaaaatcgcctcaaaaacataatccggaattggaatttctcttacactggcaggagtttttgttttaatttcctgctttgtgagcattttcggcggaacgtcttctgctttagaattcgcctttttacctaattgacgctgcacttttaatgtccgattgatatagtcaatatcactatatttcaatccattgatttcccctcgccgcagtcccatcatgactgcaaaaacaacttgcatataaatcggagttttcttgcttccctcaactaatcgggtcacctgtgaaagagttaatgtcttatttacatctattttcaccgtacgatattcctttttcttaatttttttcggcagcaaaactccttcagccggatttgcagctatcacattttttgattttgcataattcattgatgtgttcattatcgtttttgccaatcgtgcaacggattcgtatttatccgcaattgtattatacaatttcctgatatatccctgattcaaagttgacatatacatttttccaatctgcggagtcaaataattataaaccacgtttttgtagctgttataactattatcgcttattttagggcgcataatctcttccagccaaagctccataaaattagctactttgattttgccatatacaatatacgttccttcatgcaactgtccaataacttcatctcttacagaatttgcttctctcttactggtaaagcctgcatgctgccgtgttgtcgttgtatcatctgcaaattgtaataagactcggaaaccatatcctttttttatcgttgtaacagaatataccttatattctacatacttcttaaaatcaaacttcatgatctacccctccgttcccgttttccccggcacaaatacatcattcataaatgcaataattttatccttttcatccataacttcgcagtaatactcgtaagttgtgtgaatagaactgtgccctaataacccagaaattttcactaaaggaacaccacgttcacttaaaatagttgcaaacatatggcgtaatccatgaacagtaataactgggagtccatttctctcacatagttttgtcaacgcctgattcatggaacttaatcctctcggtttcccgttttcctgacaactgacatacccataatctacaaaatcttccccatacctttcttttttcatctggatgcagcgttctctacgttctacttcttccataatctctttgggaactttcaaaatacggaaactattctctgttttcggatcacgttcaattacattatattcttcaaccctaaatccttctttaacttttaaatttgccacaagctgacggctgatttgtacagtttgcttttcaaaattaaaatcactgaactttagtccaagaatttctcctttccgcagaccacagaacaatcccaataaaatttctaagtaccatacatttttactggcagcccgtagaaatatctttaacttttctttactgaaaattctgatattaggcttttctctcggataaggctttgtctctggaactgggttataattaataaatccatcaaacagtgcatctttaaatgccagacttaatagttcccttcctttatttccagctgaaggacagattttagatatctgttccagtaatttatccagatattccactgtcacaaatttcaatttcacatctgtttccatacttggaagaattagattatataatgtataagagcctaacattctggttgttgtctcaatccgtaaagaataaatatgttcaaaccaatacttcaaatattctccaaacattacatccgtattcttcagaagggcaacttgaagttcccgttgtctctccttatagcgttcttcatattcccagtagcttttttcagcttcttccggtgtttgaaatccacctttcttactatatttcgtagtcagatcatccattaattcttttgtccgatgataccatgaacttccttcaaaaaagacgaccctcttttcatccgatatatctcttttatctgcttttcttgactgcttatccttattcattctctcaccttacatttctcattccccatacaaccacctttcaaatgggagacagggaatcttatatacttttccaatctttatgacacggaatggctcctgcttttgaaaaacctcatccagaaattcataagttttggatctacccagcccaagtaatttctgaatatcctccgcctcatatactttctttgatatatcaatagaatctgtcatgaccgcacctcccttttatctctatgcaagcgataaaaggactgtacgcctatacaataacgctcagccctcttatcgtccattgtacgatttttttaatcgcatacttgacaatttaattttcgatgttctcaataatatttctttcttattaaataatcatagcccttccgtatattacaaaacatacatgtttcctttattttctgattttgatctgcccgaataataaagtgttcctttgaattataaaaaggctttgcacacaccgggcatagacacatcaaaatcggtttatccaattttttaatgcctgtgctggaacgcaaagccttgtccactttcatcatctgttctcgatttagttttcctacataatcgtctaaccgctgcttgtctaatgtcctaatctgttccaacagcacaaaagattccttctctaacccttcaattccctttatcggtacatgtgttggcagttttgttttaggcctgcttgtgatagccgcaacgataactgtcggactgtgttgatttcctcgattattctgaataattagaacgggacggtatcctccttgttcactacccaaaataggattcaaatctgcatgatatatctcccctcgttgaacttcctttttttccataaaaatatcttccttcctgcttatcgtatctctaagtcatccttatctgacaatccttttgacttatgatttagtatgtatcagccggacacatataatctttttgcatccggccaccatttttgccataattcagcctatttgtcctcgacgccccggctgttgtttgggaactcatcaagcggctgacagcagatcagctccacgggactgcacccctctgaggttctctcaaagctgtcctcacttgttgcgacgctcttaacgctcgactttatgaccggacaggagtatcatgatacctgttgtctgttatcgccctatcggtagcaatccgataattatagccagatatatctcgctccccgaatcagttaataaatcaactgcaaaccgtttcttctctattggtgggatttcgttgtcttttccaactcagttcatggcgtatctgctaatgtggcttacgctcatcacaataacaacaggaacgtacctgatgaatgactataaacttgtcaaggttcctgcctgttttatcttcataaaagaaacaggcgaaagattatctctctcacctgtttcctcacttatgcccaatttagtaacccattattgtaaaagtttttttaatttttgttctgctgctgacacggacttcataattgcctgccgagaacaatgttccatttcagcaatacgctcataggttaatccgacaaaataatacaaaatcaatcttcgctgttgtatttccggtaattgtgcaattgcattatgtaactgttccatctcaagtttctttatcacctgttcttctaataattcttccttttgaaatagtctcctatttatagaaatttccgtaagctgggactgttcataatatctgtctacaacatttaaataagaaatatcttccaactcaaaatcattaaatgccgcatataacgattcttccaattccaaatgttgcagaacaccttgcgaatccttaaatgaaagatggtatttcccatcttctgtttgatatatctcatatggattatgtttatcttttcttcttttaggctggattttctccatgctatttacctccgttcgttctgaatttttgaaaatccaaaatgaacggaggatctcgacagctggttaaacggttatttccaaataattggttgagatcaagccacttatttacttgataatgacatactcgctactcctaataagtagcgaaacacatattgcccaatgcacaaaaatccctccaatcctaaacttagaattgaagggaatgtgcacactaaatcaccccaacaaaacttcgtttttttattgtcgggttatactgtgcagattaatttacaaataataatttatcaaaaaacaaaggggaaaatggtttcttttcttcccggtaatatatagaaaaaatttctattgagagaaataatctctcttacttactagccatcctaaaagccaaaatatgacgctaaacaaaaaatttttttaatttttttcttagacgcttcattcttgcagacactgtattgggtttcatcccaatcagctttccgatttcctccgttccatagccgaatgttttcagaagtacaatagataaagttatttgatccagttccatcagcgcttttttcaactccttatcatctacagcttttataaactcctgtacattacctggctgtgggatttcccattttcctatggtatcctcactgccttctataaaatctgtatcaggtatttgatggttctggtagttacgctcttccttaaagcaattccagtcatactcatgcagctctacaataatttcttctgaaacgcctagctccctcatccttttctcttcctgttctttccacaatttccatttatattcttcttttgctttgttataagccatcttctttttcctccgatttgaaaatttttgaaaatcaaatcgaaggtggcggacttcttattcttggattatcccaatagaaaaagacgcactgcagattttctctccacagtaacgcctttctttttagaacatatgggatatggtgttttacaccatattgaataccgcacttttttccgccttttgttacggcttttttaatgtattcttataccagaaattcctcctattgcctaaaattgcacatcaatcctttattacagattctgtgcattaatcccattcttcattataatattgtttattacaccatattagatattgcctattactattttcacttttccaatattgcataatacactagattccatggaggtgaatagtacacatggcacagactgacagccgtttaggtgatatgatccgtgactgccgggaaaaacttggcttaacccaagaagaagcagctgaaaaacttcaagtaaatctgacgcattatggaaatattgaacgtgcagtatgcaatccaagccttcctcttttccttaggattgtcaaagaattaaatctttccgtagatgcctatgtattttcctcaaaagatgataccacctcggaaattacacgtttactttcaaaatgctcccagcgtgaacgtcagattattttagaaaatatccttacacttcttaaaaatcgggatgaatacacaaaaactgatgttaaagaatgattctaaatttattccgatttttatctagcttttttctagctttggaatcagcaaagcggtccatgcatacacatgaaccgctgggttatttccattgtttgattttttccaacatgttggaaggaactttcaatattccgcttccggataataaaagtaacacatccaccattccctgcagataagcttgctgattttcttcttctgcacattgctcaaccaacccaatataattttcaataatacatttctgttcttctttaatttcattgattgttcgttcataatccacctgataatttcctttttcacttactgctctttgatactctggcaactgcagatgcgaaagtcttccagtatcttcgcatcgaagttccttcaaaaactgcgccgttttctcccataggttatcatccatatttttcatcttcctttcagttacactaaacaattgtttcttttgggttattatttccttattttcgcatcgaaacacgtaataatatttttatattattcttttataaataaaataaatttttcaaaacttcatctttagaagtgtattaccatttcatttcgatagaatcaataatgcaacttcacctttagaaatattgaggatattatgaaaatatattggaatggcgaacgaaaaaatgtgatcggttctcgcgtaaaagaattaaggaaaaaacaggatatctcccaaaagattctggcagcccgcctgtctctttctgggattgattttacagaattgacgattttaaggattgaaaaaggaacacgttttgttcccgattatgaattaagtgtaattgctgattatttccgtgtaacttctgattatttattaggtcgaacggatgacaaataggacaggtactccatatatagagtgacctgtcctatttctttacaaatttatatcctactccccgaactgttttgataaaaataggatttcgtggatctgattctattttctttcgtattcgccctatatgtgcagtaacatttccttcatcacaaaaatactccttcccccataccgtttcatatatctggcgatgcgtaaagacctgtcctggatgactcgcaagaaaaagaaggatgtcaaattctttagacgttaaatttatttttttctctgctccccatactattctttcttttggattaatttttaaattttctatatttattaaagaatcatcttgtaaatgattatcggtgttattacatttaacacaaaaaatcgggacttcctttattctcccatctttttcatgaacacgaaaaattatttctaacttttttatatgttattttccctcctttcaaggattaaatattcacaattttatcacattatatggaatcaatacagtgtcctccacataaccttcattttctgttctttattgaacacggtagcctatttctatcagttcataaattaacttccacatttctttatctgtttttaaatcaactttctgatatcctgcaatcatataaaacgcaatacatttcagtctttccgatatccagatagtacagtattccttgctataagccattagactcccctcttttatttcttatcaaaaaatttcttgaatactattcatggagcaagcaatatataatactcattaatacctaattatgtcaaacgattcttataggtactaatttattatactttttctcatcgtcccggttatctttactgaaacaagatataatgctaataaacctattctgtttccttaaaaattattttctccttccgctataacattacgtcaagttttctttaatatcattctgacacagcgttattattatttcaaatacttagatttaataatttatcatgcctaaaacgtatggatttttataaaaatgtcgttgtagtaaagattattctttatacaacgacatcttttagcctaatttcctaatttaatttttctaatataattattgtttttttcaatgttttctatttttatctactgtcactcatctatttttctccctctgggaagataattttaaatacaaagaaaaagataatcatggacactccaccagtaataaacgtcacaaggatgttgtaaactgccggtgatacatatgctgctgcaatcggcatccatagattattgactccattacagatcaaggaaatcacaatccatgcaataaaataccataatgcctgatacacgggattcccatgacttttaaacgtaatattcctctggagcgggaagttgatacactgtgcaaggaatgaacctacttcataactaatgaagtatccaagtcctccaccaataattactgcaccggtgctgtcacgcagcacttcatatccaagcaagctccatgtaaattccactccaaacagattcatttccacctgaggccacataaattctgtccctgcaagtccttctcctaaaagatggggcataaatgtaaatacaagatattgaaaaatcgtaacccccatgctgaatataaaaaaataaaaaatctgatatacccactttgacagcttcggatgtttctcctcaaatctatgccatgctgtcagccatttttcttttatccctttcttttccgtttttatttcttccatcgtactatgcccctttctcgcttttaatttttcttaaatattgcttgtttactttgcgattttgaaagaaacctgccacgatctgcttaagccctttccagaagtggccgtttacgatttccagaatgccggaaaccatatccatgctgaccattcctccggtcatcttggcaatagaacgaaatggcatattataaataaaaagaatattcagatctggttttcctttttcttcgcttttccttttagctttctccagtcttcgatatatgaatcgggcaagcccgctttttgcgtaatacatctgacagatagcatcgttagcctccaggtttcccttccactttcctgatggaatagagtgtcctaaaagttcccggaattcttcatctgttatctgttgtacaataccagtatagtaataaggaagttttgccggattgtatgggtattgggatgtagttcctttcatttctatacttccttccagacggatatcttgtacacttgccccaatcataatgcgataagtcccactttcaatttcccaccgattggttttgacattccagtaacgaaaggtcttatcatcaaaaggaatcgaaatttcccggctttcccctgcacacagaaaaactttttgaaatcctttcagttctttttccggtcgaaagacaatggcatttggaagccccacatacatttgtactacttctgctccatcgcgatcccccacgttggtaaccagaagatgcacaccatcctcttgaatacgaagctgagaataatcaaattctgtataggaaagtccgtagccaaatggatactgtacccttactttactgctgtcataatatcggtagcccacatagatactctccctatattccgtatttctttctgtgcttggaaaatgataaaaggcaggtgtatcttcataacgtacagggtatgtttcacttaatcttccagatggattgacaactccggtcaggacatccaatatggcgcttgcacctgcttgccctgtcagatatccatgtaaaattcctttcatattcccatgccatggcatttcaatggcagatcccgcacttaaaatccccaccatatttttatttatctgtactagacggtttaacagatcaatctggttttgtggaatcctcatatgatttcgatccagcccttcggattcactgatttcatccagaccaaaaaagtataaaacaacgtctgcttctgcggcataatccaacgcatctttctgcaatgcctcatcgggttctccggttctttggtatccttcagagattcccaccacctgcagattatattcaccgattttctgcttgatcgtttctacaaatgtagcatttaccatggaagaacctgccccctggtatcttggtgttactgcaaaatctccaataacggcaactttcgttccttctcttagtggtagaatatggtctgtatttttcaaaagaacgatactttctgatgcagcctgctttgccaatgcatgatgttctaatttttgagcgttcttttttctttccgttttttctttctttaaagtatagatggcatccaggagcccatctacacaaaaatccacatccttttcttccagacttcctgctttgacagcttctacaatctgccttgcagaatccattccaggcgccggcatttccagattagagcctgctttcactccttttacatgatcattggagccgccccagtctgtaactaccagcccatcaaatccccattctcctcggaggatatccttcagtaaatgtttattttcattggcatatacaccgttcacctggttataacttgtcatgattgcttttgcgtttccctcttttactgcaatctcaaatccagtcagataaatttcccgtaaagcacgttcatccaacaccgaattcattgccatacgccgtaattcctggctgtttactgcaaaatgttttggacatgcggcaactccctgactttgtatcccacggatatatgctgccgccattcttcctgaaagatacggatcttctgaaaaatattcaaagtttcttccgcataacgggcttcgtttgatattaagccccggtcccagtacaacatctactccctgagcctttgcttcttctcccaaagcctcaccgattttttctcctaactttggattccagctgttggcaaccgttgccgcagtcgggaagcaggttgccggaagagaagggtttagtccaagatggtctcccgctcctgcctgttttcttatcccatgaggaccatctgacagaaaaagagacggcagttccagtctttctaagtcccatgtttcccattcaccttttccacttaacagaaccgctttttcttctaaagtcatcttttctatgatttctggatatttcatttctgttcctcttttctgttgaaaaaggggctacttttcccttttgtgcagcccctcttttctcgtatctatataattactccaccttgataatgacgtccatttttgaacgtttgcgatatcttctgatcagcaatacctctgcaaggataaagattactgccagtcccgcatcaataccgtaggtcatcttcacccatcccggaagttctcgtccagaataatcctcgtaggcaatactgtttacaacggtatacatgatattttttgatgcctgacgcattgcctgcacagaagttgcactctcatcatctaccacggcgcgtccgccggtcgttcccagcatacagtccgtgcctccgcggattgctctgtctgcatccatatagccataatctccgaaataatcagacagcaccattccacggaatccccattctccacgaaggatatcatttaagagaggcccatatccgccgccccactcatttcctatgtagttgaagcaggacatcattgcaagtgcttctccgtcatttgattttacacagtcttcaaacggtttcaaataaagttcccttgcagactgttcggaaagccaggtacaaagcatggcatttcggttggtttcctgttcgttgaatgcaaaatgttttaagtatggatatacgccattttcataagctccttcacaggcagcaactgccataacaccgcttaaatacggatcttctgaataatattcaaagttacgtcctccaaatgcggaacgatgcagattcattgccggtccataccatcctgagaagccaaactctgccgcttcatttgtaatgcccaatccgatttctctggaaagatctgtgttccatgtctgtgcgatcaaaagttctgaacagtagcctgttccaaaagaacttgtcataaatgaattgattcctgccggtccgtctgtatccagtgtggcgatttttcctaccgagtcaacggctactgtctgaaagcctccataagcaatcagattcttcatatcagccacgcttaaattatccagtaattcttcccagcgttcatcatcataatcagcgcctcttaaatcattcagctcaatgtcatttcccgcatccgtgacaggcatttcatcttcttcgttattataatctgtcggatcgtaagttccattccccagaagttcttcctgaagttcatgttcctcttcagatggtgctgcagttgcggatgcataatttgcaaatccatttgcccttgacagatattctccgtttccttctgcagattccatacggtttaccgcaacagttttgtcatcagatcttggatgctcttcgttatacacgatttcattttctacagtcagatttttggaatccactactgtatgcgaatctgttctcaaactaattgcataatcgccagattctaacacataacacccatttccataagtatcataagaagccatgtcttcttcgttgaatgttaaggtcaatgtctgggaagctcccggctcaagcaaatcggttttgtccatagctgccagattaacggaagacttttcaattcctccgtttgtatacggcggagtgtagtataattccaccacatcttttcccgctgtatctccggtgtttgtaaccgtaacatccacagaaactgtaccatcttcagctacattcagctctcccatctgctgttcaaatgttgtgtagcttaatccataaccaaagggatactgtaccatttcttcataattgattacaccgtcatctgatgctgtttcatagaaacgatatcccacatagatattttctacataatttacaaatccagctacaccatcggctgcttcccatgatgcttctgctgccgcaacgacatcatccacgttggtgtaagccatatgcccgatattattaaaataaggagtagcagtcacatcatatacccatgtatctgctgtttttccggaaggatttacatcacctgccagaatacttcccagtgcattgaatccggttgcccctgcgccaggaactgaaaggagggcatcaatctgctcatactcgtctacccatcccatttccagtgtgtttgctccattataaacgacaaccacatcatcaaacctgctgcacaccatttccaccaggtctctttctgtccggcttaattccagataagtctgtccatcttcaaaatctgcgtactcatccgaattattttcatattttgcattcagatattttgtccccggttcattccatgatccgtccataacagcacccatatcatgtggaagatcagaaccttcccctccagaacgcccgattacaatcaatgcagtatcggaaaattcctgtgcttctgtaagcattgcttcgctgtaatcttttaccggaacttccggaagtgtccagtcctgtccttcctcattgattccgattaccggacggtcttttcgatattctgtatacatatctgaaagttctgtatttaatgtaaaacctgcgttttccaggccatccagaatactgactgccgtactggtatccactgtaccggaaccagttcctccgtataccggattggtagatgcccagccaaatacattcagatttcctttttccaaaggaagggttccctcatcatttttcagtaatacgattccttcctccgctgttctttcaatgatgtctctggattcattcactgttttttccgaaagcgttcccatttctgtcatagctgcagatatcacgttattcattggtccaagacagattgcatttacgattacgacagtaataagtaaaaaggcaagtactgcctgacttcgaataaacccttttttcggttttcccacctttcttgctgctatcattacgataatcattgcgatcaatgcaattcctatcgcaatcagataacccgaaatctgttgtacaacactaacaacatcttcccatgctacttgaatatttcccattcctgtttcctccttcttgtttatttctttagttttaaaataccagaaaaatgtgtataaaaatttttttggtaaaatcagtaggaaatcaggtaaaatcggtaaactgcccggtgtttaacccaaaaatagcggcttgaataagccgctgaacttgttacctctcaaaaaagataatatctgtctgaaatttctgatttacttttctcattaaaatatcgccatgatatttttctacaatatactttacacttctgactccgaatccatgataacttttgtctttctttgttgtaagtggaagaccgtcttcaaaatcaatctctttgctgcagtagttttctatatgaatatgacaaccgtcatttttccggtttacctggacgctaagaatccttttttcttctttttcctgaagaaggcattcaatggcattatccagcaaatttccaaataaagcgtatacatctgtggaatgcatgaaattcaaaagggttccgtctaccatacaactgctttttatttttttctcctcacagatcaggcttttctccgtcagtgccaaatccagggcacgatttcctgtctgataataattatcataaatggtaatcgcattgcgtatttcgtcaatatattcctgctgctcctgttcattttctatcaatgggatttttttcaatcgatattttaaatcatggcatttgatattgatgatatcaatgctttctctggacattttctgctgctcttccatgttgtggagcatctgttccatcagttcattttcatgaactacccggttctgtctagaaatggaaaaggccacaaaaatagctaaaaagctgcatagtaatgcatagattttacaatatatattccgcaggatctctgcattctctgtaaactttcctaaatcaaccaaaacactgagaaaaaggactgtaaaaagtatgataagggacaacaaaatcatacggaaatctttatcgacaagatctccttttcctaaataccgttttacaaatacaaaataaacaatccctgccacaagaatgtacggtaaaatccggagaagtagaaaatccagtaaaaaaggaaactttatcgggacaagttcagaaaaaatggtatatatcgcaaagccaatgtgctgggttgcgtatccacataccccggcaaataaaatttcttttttgtccacttgaaaacaaactttcatcatacataagataaagaaaaaaagtgtagcataatatagcgtatatgtgatagcatatccgcctggaagagcacaaaacaaaaaaaacactcctgatgccaatccccaatatcccactattgctaacaatattcttataaaaaaagaacttttctttttccagttaattataaaaatagattctgtaatcataagctgaagagaaaaacgcagaaatgaaatgtactctaactccatcaaaattcccctcctatatatttcataaaatattctttaaattcttttttcttctgtctgctcactggtaaggtcttttctcctatccatactgtatcattttcaatttttgtcacatggcgtagattaaccaagcaaccttgtatgctttgagaaaatccctcttctttcagcttttcgtttacagctttcattgttcctctaacccgtctattccctgtggttgtatgataaatcaaataatttttatctttttctatataatatatctgtgaaagtataatcttttctacagaatcttctgtttcgattaaaatctgcttttctttatttaattgacaaaatcgaattgctttttttaatttatctgcaaaaacataatattctatcggttttacaataaaatcaatagcattaacttcatatcctttgatagcatactgtgccatatttgtcacaaatacaattcctaccgaagtatccctttcccgtattcttttcgccgcttccagtccgttcatatgcggcatttcaatatccaaaaaaactacattaatttctccattataatcttcgacaaaatttaatccattttgaaattgaaaaactttacaagatattttctcctctgtttcaaatttttggacatatgatgacatcaccttcaaatgttcattgtcatcatcaaccaatgcaattttaatcataatagttccctctgtattgtttttacgattagaataccacataagtaaatgaatagaaaacctcaaataaaacttttatttttaaaatacttattctcccataggaatatataaaagtactaattgagcacagactcctgtaaacgctccagccaaacatccggaaaccaataaaaacggaaaatatgtaagcattccccacccggcaattaaacaggcaacgatggtctgccccaaattatgaaaaacagctccaaatacactgcacagccaaatatatttttgtggaatcactttcttcaaaaaaagcatccccataaggcatagcaaaccgccagccaaactatacagcaatgccatcatattcccgctgaaaaatgccccaagtaagatacgcacaaccacaatcagaaaaacttcccttgcccggtactgataaacagcatacacagagataatattggcaagtcccaattttgcacctggtattgggattggattggggatctgcaattctaccacaaaaataataagggccacggctgtcagcaatgataactcagtcaatttttttgtattcatgcctctgcctccttaactggctcttccgtctacttcatccgtttttttgaaaactgaatcaccaaatgattcggaaggcaaacaattggagtggatgaatccaaccatcccatattcacacaggtatgatcggggcagtcggcttccaacatgtgaatttgatgatcctgaatttcaattcgattgactcgactttcatattccacttcaatgatttgattctctaccttctgcaaatccagttgatacagcacctctccatcttgaacaatttctacaatatctgtatccggccgctggagcagcagaatactctctactatcccaacgaggagcagcataccagccaaaagaaagggtagtttctgtttcatcgtttcaacacccggactgtttcatcacgtccatcgctcaacacaaagctgtcagcaatcccttctgttaagatgatttcgttatcttcggtaacaagcagcatatcaaaaccgctgttttttctccaatatttttctgctttttctggtcccataacaaataaagttgtggaaagggcatcgcaggtctttccgtcagttccaataattgtaacggactgtaagccgctgtgagccggaaaaccagtagagggatcaataatatgccaatagatgtttccttgatcgtcctcaaagtaattttcatatcccccagaagtgactactgcggcatctctgacctgcaaaactcccagattttctttctcccagggagcacgtatacctatacgccagtctgttccatccgggcgagaacccacagcctgaatatttcccccaaggctcaacagagcagactctatcccttgttcccgcagaacctctgttgccaaatcagccgcatagccttttcctacggctcccaaatctaattccattccgtcgggaacagtgagcctatctccttgcagggaaatctgagaatagtctaccactgaaagcaattgatccaattctttttgagatggaacctgcttttgctctgtggtaaacccccatgctcgcaacacaggataaagggtgggttccaaagctccttccgttttcccggccatttccaaagcaaacgaaaccagtgcaactgtgtctgcactcacccgcactgattgtccgctgctgtgatttgcttgatagatttcactgtcctcgtcagtaactgaccacagggattctaattcttggattttctgtttagcactttctaatgcagcttcactgttttcaccgtaaacggtaaaagtcatataggtgttcatggcaaaaagggaagattcagttcgcagttgttctgccttttgataagaactgcacccgaaagtaaaaaacattaaaaatccggttaaaaaaattaaaattctctttcccatcatatcttccctccaaataaaagtggcagcagatgaaaaaagccagccgccgccactcatatttctttgattccacatcctactctcagatttttatcacgccagctttattttaagtttacatattcctcatccgtcacagcttcgcaccattcattcgtggtttcttctccaggaacttcaacagccaagtggacaaaccaactgtctttggctgcgccatgccaatgtttcacttctgccggaatctgtaccacatctccggcatggagctttcttgccggttttccccattcctgataccaaccttctccggcagtgcagagcaggatctgcccgccgccgcttttggcatgatgaatgtgccagttattccggcatcctggttcaaaagtaacattcccgatggaaacgctttctgtacaaagcatattcagatagctttgtcccacaaaatactccccaaatggattcttttctcccatatcaaaaattgtattaacctcagaggtattcattacgcacgctccctttcttcatttctttcagaatcgcttttccgctgttctattttacaagttgattccataatggaatcttgttttatgacttctccaatgctatccgctgttatccgtccggacaatggattctttaccgacaaaatgttgccggaaacatccgcctccacatcagaatattcaaaggccaaatcagtctgctccattgtgcagtcgatcaacttcagatttttgcagtaacaaaatggttgtgtcccgataatacggcaacggatcagtgtaagcccttcagaataccatcccagatattccccttccattacgctgtctgttactgtgatgtttttgccgtgccaaaaagcatcttttgtctttagctggcagtgagatacaatactatcccgcacatactgaaaagaatatttcccatttagggtaatttctttcagatttaggttttcactatgtaaaaatgcatactcactggtaattgtactgcactccatttccaacttgctgcactgccacccaaactcagatgaattgatccggcaatttttcatggaaatatccgagcattcccgtagcgccttgattccatataagtcacagtcatccagattcagatgactactgtaccatagagctgcccggcaggtttccttcatgcggcattgcgaaagagaagcagtacggacatgccagaggggatagcgaagaaaaaattcacagttctgcacaacaacattccgtgcttcctttaatgtggattccccatccgctggtccgacaaaggaacacccctgaatcaaggtgtcctgctggtgatataatgctctttcttcatcaaatgtttttccaataatttgcatatctgataccgcctttgtatctgctcaacggtatgccttttcaaaaatcccggcgcactcctcgtcggacattggtacacgatcacaggcaaacaagcctcccatagtcgcacgggcatttttcgccaacgtcataaattcatcgggctgaatcccgtagtcggacattttcaggttatctacgccgcactgcttttgcagatcactgagagcaacaatgaaatccatcggctcctttgcatccgttttccccagtgcctgtgccatacgaacaaaccggtcatcacaggcatgtttttcaataaagtgggtaaaatacgccttggaaatcataatcagaccggctccatgaggcagttcatggtgatacgcactcatggcatgttccatagaatgttcgctggtacaaccgctaaccgtcatgacaacaccggaaagggtattggcaaacgccacatgctctctggcttccagatcggaaccattccgaactgcgcggggaaggtatttcccgatattctcgatagcagtaagcgcatacatctctcccatcaggttggctgcattggaaatataacattctacactgtggaacagtgcatcaaatccctggaaagcagtgaatttcggcggcacagatttcatcaattccggatctacgattgcaattttcgggaaaagggaatcatatccgccaaaaccgattttctcattggtttcttcgttggaaacaacgccccattgatcgacttcgctgccggtgcctgccgttgtagtaattgctataatcggcagaggttcctttgtcagtgtcatggattttccggttcccccggcaatataatcccatagatcgccatcatttgtggccatagctgcaatggctttggatgcgtccatgacgctgccacctcccaaagcaacaataaaatcgcatccggtttcttttgcacaggcagctcctttcataacggtggatttcaacggattggccatgattttatcaaacaacacggtttctacaccagccagtttcagttcttcctctgtccttctaagagagccattctcttttgtggacttgccatttgacaggacaagtagcgcctttttgccgggaagctgttgggtatgaaggctgttcagctgaccttctccaaataaaattcttgttggtacatacatttgaaaactcatagtaaacctcctaaaaatactttttaatttctatccactgcgaagaatatacggggttatcttttccagttatgtccgaaacccttttgttctgattctatatgccctctatgcccgtagacggtacatctattcaatgcggattccaacgctttgaattcctctgtatttaattctacattccagcttcccagattctccaatatgcgttcctgattttttgaaccaggaattggaacaatattgggatatttgtgcatcatccatgcaagagaaatctgagccatgctagcatgcttttcttttgaaaactgctgcaaaatttcaagaataggctggtttgccacaagattctcctttgaaagctggggcacaaattttctcacatcatcgccttcaaatttcgtatccaaagatacttttccggaaaggaagccacttgcgatcggagaaaaaggtaccacaccaatacgattctccagacaataaggaataatatcctgttccaaatcccgttccaccatagaataaatattttgtacagcagagaccggagtcactgtattagctttatgcagcgtatcaacggaaacctgagaaagcccccatccgcgaatccagcctttttgaattaactttcccatgacttctgccactgattcgacagaaattttttcatttaccctgtgcagataataaagatcaatgtaatccgttctaagacggctcatagacgctttcaggtgtttaaccacattttcgtatagatccagattttcctcagcaggcggtaaatgcaatttagtagctaaaactatgtttttgcgaaatggagccacagcctctccaactaattcctcgttatgtccgggataaaacatctctcgtccatagctctctgccgtgtcaaacaatgtgcagccaaattcagccgccttccgaattgcttcgacactatattccctgttaggaacttttccataaccatgagaaaatcccatgcaccccataccaatgggtgatacttccaaatctcttaattttcttgtttccattcttctatcattcactttcttgtttctgtttatttctactttgcttatttttaaatttctgtttccttgtagttcgcttggaaagcaattttgtactataataagccacacatgtccacaatcccatcatagcaatatattcgctaaaaaataatgggagtggctgttccatatcaaagaacacaaaccggctgcggacaaacatatagtcgagcaagttgttcttgcaaagtgcatagatgccaaatccacaaagcaccacggccagaatccgcagaatccatgtacgagccaataatggctcttgcccgccggatcgcttccggagaattcccataatcatcccccaatgcaggccaagatgaacactcataaaaacaaatccccaataggccgccagcatgtgcagagtacgggcaaaattcatccctccgtccaaaggcaggaaagcgaatacaacccgcgacataattacgccgcttaccattaaaccaagcatggaaaaaagtatcaggaaattgacagccgtctgtagtacacgaactgccgtatatcgtcccttcacaaggttccgataccatttccaattcagcacattatgaagcaggaataacgcaaacatagcggttcccatccactcatgagctgtttcaccaatcaacatataagccatttgacatagaagtaaaattgtcatgataaaatcaatggacaatttgataattattttgggtttcaaataaccccctcctttccaggcaagaatgaatctaaccttacaattacaggataatatctttcattatctatgtctaatgcttatattgaatcgtattttatgcttaataggcataaaaaaagaagctgttttttaggcagcttcttttttttaaaactgttattctccaaaataatctcggattgttcgcatccgttctgtctgtataacatggaacggacagcgggaatcacagtgaccgcagccaacacaatcccctgcgttcttttccagagtggcataatgaacttttgccaattcatcacccgccagcaccaaatcgtaatatttgttaatcaatccgacatccagtcctacagggcagggctgacaatgattgcagtaaacgcagacaccggctgcttctttgggcgcaaatgttcctaaaatagcataatcccgttcttccgatgaggaattgacaaaaccaagaatccgcttcaaatcatcccgattccgaacgccgggcaatactgtcagtacgcccggtttatccagcgcatattggatgcactgatattctgtcagtgctttaccaaaaggggatgttttcgcattcagcagctgaccaccgctgaatgctttcataacagaaattcctacgccctctgcttcacaccgacgatacagccccagccgttccgctgcgctgccaaccgcataactttccgaagcataatccggctctgtgccgccggtataatcgtaagccggattgatactaaacataagcatatccaggattttagcatccaaagccttatgtaccacacttggcgtgtgggaagaaaggccgatatgacgtacaactccctgatttttcagctcctgaatatagccgaggattccatcatccaacacatgctgaagatcagtggcttcatcaatacagtgcaaaaagccaaaatcaatataatctgttttcagggctttcaactgccagtcaatggactgtttaattgtgtccaagtcggttgtccagccgtatttacctccttgataattggcaccaaagtgaatttgaaagaaaacatccttccgttttcctgcaagggcgcgtccaaaagcagggaagggagccgcatccgcagatgccatatcaaaatagttgattccattctccagcgccatagtcattgtcgcttcaatttctttttccccagccataccaatagaactggttccaaatcccaacacactgattttttcctctccatgaggcagtttccgatattccataaaactcctcctattactgtgtttcaatctcattttgttccaaccatactgccacatcatctggcatggaggaacctcctgaatagttaatggcaagtccttcagcaatagatgcatctggaactaattttgcaatagcggttaaactctgcccaaatcgtccaccaccatgactgcaaaacggaaggatagttttttctgtaaaatcatattcctctaaaaatgaggcaaccggcatggggatggaagcccaccagttgggatagcccaaaataattgtgtcatattgctccatgttttctacacgagtagaaagttcaggccttgcttgttcgttctgatccttctgagcctgatctaatactgtattataatccgtagagtagggttccgccatttggatttcaaatatattcgcacctgtttgactctgaatttcttctgcaatctttcttgtattgccaccccatgagaaataagcaatcaatgttttcccagcaccagtatgtgtcgtttcttgttgggaaccagaaacacttccagaaccagccactgcatttcttaccaagcggattcccacattaaaactgccgttttcctgcggtgctgcagcacgatagcctgaacggagattttttgcaaaatcgttccagccgccacctctattgactcttctggttccggtatctggtcctgtaggattactctgagattctgtttcatattctccatagtaatcccaaacccattctcctacatttccatgcatatcatacagaccccaagcatttggcgaaaaacttcctacctctactgttgtctgacgataaacaccgggttttgtttccagattttcctgagaaaaataattatcctcaatcatatagggataatcgccccaataattggcttcgtcagcactgatagatgtctctgtattaaaaggtgttatcgtaccagcccgacaagcatattcccattccgcttcggttggcagacgataaccatttgcactgcgatcccaattaacactggtcccatctattgtatagacaggagtcaatccttcctgttcgctccgtgtattgcaataggttacagcatccaaccaagacacctgttctaccggcaaattttcacctagaaaattacttggattttcttttactatatcttggtattctttttgcgtgacttcataagggctgatataaaaatcgctgactgttactgaatgctgggtttcatcttctccacgccacgcctcgctgtccgggctacccatttcaaatatgccgccctcgattaaaataaaagtttcaggaaccgattggggttcttcactcttttctgattcaatcacggatgttcgctcagaatttatttccgttgaaggattttgattacatgcagttacagaaaaaagcataaaaatggccataaaaaatgcggtaagttttctcattctatcatctccttagcaccatatgaggctttattctttcttattatattatcgtcagactttttgattaccgataaaccatacatgttcgttctttgcagtagcagaagtattctgtgccattacacctactaatttgtggggaatatagagttcttccaggaaaacgatttcctcagccgtcaaagtgagctccacggcttttgccgcaccctcaatgtggtagagcttcgttgcacctacaacaggggccgtcacctttgtcagcagccatgcaagcgaaatctctgtcatagatacgctgtgcttgtcggcaagctgtgccacacggtcgatgatgctactgtcctgctcggcggtcgagtcgtatttcagatgtgcatagctgtcctcccgtaaacgctttgaggtttcaccggggtgtttggaaagtcgtcctcctgccagcgcactgtacggtgtcatggcaatattgtcctcacggcagagttttgtcatttcccgttcttcctcacggaagatcaggttatagtgtccctgtatcgacacaaattttgcaaatccttctttttcggcaagcgcgtttgcctttgcaagctgataggcaaagcaattggaaataccgatataacgggcttttcctgcttttatgacatgattcaacccttccataatctcgtgcagaggtgtattataatcccacatatggtaaatgtacaaatccacatagtccataccaagattttctaggcttttattaagcattttttcaatatgctgctgacctgtaattcccgcttcaatttcatcattggtacggggcaggaactttgttgcaattatgacatcatcacgctttgcaaaatctttaattgccctgcctagatactgttcgctggttccgctttgataggcgattgctgtatcaaagaaatttacgcccagttccaagcctcttttaatgatttcacgggaatgagcctcatcaactgtccagctatgctgaccgtttccggcttctccgaatcccatacaccccatacaaatacgggatatatcgagatctgtgtttcctaattttatgtactccataaaaccttctcctctatatatgggctttacattttttcaaataccctgaacactgtaaaactaacccagttccattagattgtttttatcgttctccatttaccgcctttatagcgccaaacaaaggcaacagaccttgcaaaccagtccattcccatagcaatccagacaccgatgattcccagattcaaaacaatgccgaacaaaaccgcagatcccagtcggaataccaccatagagccaatccccaccagcatagtaaacttggcgtccccggctgcccgcaagctatgagccaaattaaaggatgtcgggtgcaaaagaaatgccaggatattatgcatgataatcaagatagctgcataccatagggtttcttctgacagattgtaaaattgcaaaataatgggcaaaagtacacatacaaggcctcccaatatggcagtagagagatatgaaactttcattaactttttggtattatcctctgcctggtccagcagtcctgcaccgatgcactgaccaattaccgtaataactgccagattgaccgcattaaccaccacaacagcaatctggtcaatactgtttgccactccatttgcggcaatctgtgccgtaccaaacagggaaacaatgcttgtcaccataactctgcccaaggcaaataagccgttttcaatcccattcggaactgcaatccgaaggattcttcccagcagttcccgcttccatgagaaaatatcttccatcctaagtgaaataggattttttctttgaaatgccaatacggtcatcaggattgctgacagccctctggaaatcaatgtcggaaccgctacaccggctactcccagatgcagtacctgtacgccgataaaatccccgatgatatttaccgtattcatcaagagggaaacatacattgtcacgtctgtctttcccatagagcgaaacattgcagcggaggcattgtagattccaagaaatgggaaagaaaaggccgttatcgtaaaataaagtaccgccgcttccataacatcggcttcaacagttccaaacagcagatggagcagcccatatctggacaacaggcatattgtcataattcccagcgaaatcaaagtagaaatcatcagaagctgagaagcagactgttccgcctgcttgtcctgcctgcttccaagatactgcgacacaattactgcaccacccgtggaaacagctgctagaaccgtaattaccagataattgaccatatccaccaaggcgacaccggaaacagcagcttccccggcagaggaaaccatcagggtatctgtcatccccaccatcattgcaaagatctgttcaataatcagtggaaccagcaaattacgaagcataccacctgtaaataacggagaagccgtttcctttaagttcgtcttttccctgcacatagttggttacgccttttcatggattttttccagccatgcagtaaccgtggtttccgtacggctgccgccatctccggaaattgcaagacctggaaggaactcagcagaggcgcaatatttcttggtatctttttctacattggtcattccaccacctccgtgggtacagaataccgctgcttttttgccggaaagattatttttgtgaagaaaagaagccagtggaggtgccatcgttccccaccagttgggagtacccagaataatcatgtcgtaactgctcaaatcaactttctctttttccaatcgtggaaaaaagccctcccgaatttcttttttcgcctgttccagcactgcattataattttgagggtaagatggcaaaggcctgagttccaataaatcaccatttgttttttgagcaatatgttctgcaacttttctcgtatttcccgaatgagaataataaacaaccaacgttttttccataaccattcctccttatgtccttacagacttttccccaattcataggctttttgcgggtagacgctatgctctattacactgcggcttccacagccaccggcaagtaacatccccgcgtctgtccatccaagatactttactaaagttttgtaatgagcagtcagtgcctggaatgtccagtctttatcatcataggctgtcgctaacaatatgagctttttcccgctgtccatcaattcataattgaaggaatagaaccggtcaattaccatttttatttgtgcggacattccaaaataatagagcggtgttaccaatacaacagtatccgattcttttagatgtggaatgagcttttccatagcatcccgatgaatacaatttccggaagtggcgcagcgatcgcatccaaggcaaggatgcagatcttcaaaagcggcatcgaagcgaaatacctcgttacccatttcttttgcaccacggataaattcatccgcaagcaacgcagatgtcccttttcggtgggggcttcccgtaatcactgtaattttcatctcaaaatcctccttaatactcaagttcattcaaccaatccagaatatcttgctgagaatcagccgcatcttcttcataaacatcaaatacattgtcggaaagagagacgttgtccggaagcacgttttcaatgtcctctacactgcccgcaagaccgcctgttccgtgagagcagaacaaataaatctgtttttcagacaggtcattttcctcaataaaagataacagtgccatcggtgctccataccaccagtttggataccccagaaaaacagtgtcgtaattttcaatattgtctacggtttccttaagttccgggcgggcattttgagaacgctcttcatttgctctatcaagacactcatcccagtcgctggaataaggttctgttacctgaatagaaaacaaatcggctccagtttcttcctgtacccatgttgccaactgcgccacatgccctggtgcagtaacacttggcgaagcaacggcatccacgtctccttcgattatcgcattatctgcccaagaaaagtaggctactaaaacacgattttccgtacctgtttcttgtgtaattgatcttccctctatttcagaatgattctcggatgattctatagtttctgaatcattttctgttttgttctttaaattctgaccagaggtattctcttgactacacgctaaaatggaacaggccagaacaatacttaaaagaattgccataatttttttcatatatattccttccttttaaccataaaataaacgcattttcctgtatccaagagaacgcgcttagaagaaatcatccaattaaaattttaccactgcttttaaaataggatcgtcatttgatgtaagccgttcaaatgtctgctgaagctgtttgattgaaataatatccgtgacaaattgttccggctcaattgtaccatttgcaatcaattgaatggtttcttcaaattctttacgcgtacaagacacgcttccttgcagacgaatctcatgaagtaccgcctgattcatagcaaaagatactttttcatcaatagaattaccaatcataataacttctccgcctgctttaacactactcatacaagtttgtaatgcagatgttgacccaaccacttcaaatactacatcaaatccgccctttgttgcttctcgcattttttcggtagcacctgggtcatttccatcaaagaaagaatcaaaaaaattacttttctttgctcttgctatttttaaatcattcactttagacattgccacataagaagcaccagctttttttgcaagactgccaatcagatgtccaataattccacttccaacaaccaacactttactatttaaacctacatctgaatgtttgactgcatgataggccaccataagtggatcaatcaaagcagctgatatatcagttacagaatctggaagtttatacgcattcattgccttgcccacaaacttctctgcataaccaccattacagacaaatccaatataatttgttccatttacctctttacataaatgctcttttccggctctgcacatctcacattgtccgcaatatagatttgcccagaataccaccctgtctcccacgttaaactgactatctccgggatttgtaacaattccacaaaattcatgtcccataatgaatcccgatttttctatctcataccagcctctgcccgatctccacatatgaacatcactgccacagacaccgcaagccgacactttaatctcaatcattcccggttctaatttaggaatgtcaacttcccgtacctcgattttttcaggaccaaccaacacagctgcctgcatcatttctgatgacatatctattgcctccttctttactgaatatatcctaaaccagtcaaccattcatcaatctgttcctgtgcttctgttgcaccagaatctgaaatttccagtccttcctggactgttgcaccagattccattccctcaatcgtactaattgtgtcggaaaatccactacctccggaagtaacaaatggtactatcgtttttccagaaagatcagcctgatccaaaaaactatacatagccatcggcatatccccccaccaattcgggaatcccaggaaaataacatcataactgtccagattttccggcatggaatccaattcgggacgttcgtctgcgtttcgttcttcttgtcctttatcaattgttgcatcataagaatccgggtatttttccacagttcggatggaaaagagttctgcacctgtgctctctgcaatcatattcgccactacacccgtattaccggttaactggttgttccatgtctggatgctggcacttgaagaactatctatgccttccggtaattctgcattttctccataactgaaataagctaccaacatattactgtctgtttcttccacagtttgctcagagacaggtgtttgttcttcttccgattcctctgtttcagaagaagacgtttcactttgaatagtttgagaatcttccgatacctcatttttttcttctccattgcaggctgccagtgacaaagttatcaatcctgccaacagaagtacactcatttttttcattttcatttacctcctatttttaaatcatattactctgccaattcaaaagtaacttccacattaccgggcagttcttcaaatacagaaagatcagatgttactttgccaattgggattacttccacggagagaactggatcatccgtctgtgcgtaaaacacagccatattatgatgtgcctcacaatacgttatttcgccattttcaaaggtagtttgtccaccttccagattttccgggtaaaaatctacaccaccataatattctctgccaccaaaactgaccatagaaactgtcaaagggaaatatccccttatttcatttgcaagggccgtatcatagagaacaccgtccaatacagtatcacctactgtaattgtaatagcggtttctccggcttgagcagaaccgacagaagtggaactactaatgccaatttcttgcagccactgtaccacagtatctgttgcttctgggacatccggtgcttcaatagccagcccatccaaaacatccgtttcaccatcaatagcttctgcgatttcctgataactcccccccgggccataaccgtcatgtgtgcagaaaggaattacagttttaccagacaaattatattctgacagaaaagagtacactgcctgaggtgcattagttgcccagataggatatccaataaataccgtgttgtactgagaaatatccaggtcgcttgatttcagttccggaagaattccagcattcatttcttcatggttttgatcaacaactgtatcgaaatccgtagaatagggttcctcggtcacaatggaatgaagatcgccgcctacattttcctgtatcagttgtgcaacatattctgttgttcccaccaaattttctccattcaaaataagacttgcagaagtactagcatcaacatccctagaatactctgcattaggcccaagggaaaaataagcaattagtacatcatttctttccacggattccagttcgctgttctcattttcaagttctgatgttttgttatcggatgatgacatactactttcctgtgatgttgtctcttgtttttcacaagccatcagagaaaaagtcatcgccagtgttgctaaaattgcaataatttttttcatcaagatctgcctccttataatttattgttgtttaatctcatggatatagtaatccaatcgatctaaacacttctgtttacagtgaatttcctccaacagctgataccgatattttcgtagaatttgaatttgttcggtttttgcagtttttcccttattcaacaaagtagcaaaatattttaaggcgtccatattcatgcctacttgctccaaaaaacaaaattgtgtagcaagctgtaattctttaacagaataatctatagtcccatcttctaagggaatacctttgagcaacccagctttttcatattgctgtatcatttcagctttcaaatctagttttttacttgcttctcgcaagttcattttataccatcctttcaaaaaaataatgtaagtgttacagagaagattttctgctacacttacattatagaagagaaagtaatttcatgtctaatacttagtttttatagattaaaatgctcattaggcatggtttaaaaagattaacttatattctatgaaatcagattgtgtttcatatgctcaataaatttttcggtagctacaccaaaaggttgctgtcgtttccaagccagaacgcagcttgctgtcagttccggggaaagcggacgatacacaattttttctttgtcccaaaaagccagtgagccttcaagcgtaacagaataggcaagacggttttttaccataacggcggcattggagggtagattatttgtaaatagaacttgaaggtgttcaaaattctcgccaaaccaattagcaagttcgctttgaacattaattcgtctaggaaggatcagaggcttatctaacaaatcaccagggcgtatagattcttgcaatgccagtggggcatctggatgcatagcaacaacccatctttctttttgctttagtcgaatgaactcatatttttcaatattgatcggttccagtaaaagcccaatatctgtcaagccacgttctattcgatctcgaatatgatcagcagtagcagtatataaatcaaattttacggccggataacgttcatgaaaagtttggaacagctctgaaagaatctgaacatttttcaaatcgccacagccaatagaaaccgttccttcaactgtttcatcctgcacggttaattcccgttctgttttatccactagttccagaatttcttcagccctgcggcgcaaaagcaacccttcatttgtaagaacaatttttcttgttcctctatcaaacaattttattcccatttcttcttccatttgagcaagttgtctgctcaacgtaggctgtgttatgtgcagcacttctgccgcttttgtaatactttcttctctcactacacttaaaaaatatcgcagcacccgaatttccatcacgatctccctttctatgaaatcaacatttttaataatagacattgattttagcaataatattttatcttattcatgcctcataagcaatctattattttaaaattctttctaagcatggataaaaattcaatctttccttgctcgttatttatacaatgatatttctattatctacataataattccatatcctaaaatagtgggggctccaattgaataatcatgctgccatactcccctcactctatttccatcaataattgtgcctgtatttccttctacagtataaatgatacctccttcacatttttccacgatgcctacatgatccgatataccatctccatcccagtcaaaaaaaaccaaagaacctgtactcggaatacttcctttttcctgccattttccatggtttttaaaccaatcaaccccatctttgcataaggaaaatttcggcatcgatcctctttctaacaatccggcttgttctccgcaccaactgacaaagcaggcacaccattctctatattctccgaatccataccaacgccagtattttcttatgtatcccgctgccaacagacagcaggatgggacaagttaatacgctggtattccaaaaccttcaatctgttcataaccaagcgtataacttctctttgctacttgatccccactgtttccttccactgtgtagatagttccgtctgctaccctttctacaattcccacatgatcaatacttccatcattgccccagtcaaagaaaacaatgtctccggctgccggaacataactgccgtcacggaactgtccccggctttcaaaccattccattcctgccgaacacaaagaaaacttcggaattgctccaacctcaatataaccacattgatctgcacaccagctcacaaagcaggcacaccattctaccctttgtaaaaatccataccagctccagtaaacttcccctccatttccttcctgtgtcaaagccacctgtacgattgcctgatttccaccctcggttgggatacgtccaaacacatagtatctcagtacatgagacacatattctttatctccataactgctccagccattccgttctgccatcatagtggaaaattctactgcattggcataggtatatccaccgtccttttcttttgcccataaaatatacccatttccatagttataaccctgcaaagccagcttgataggattcatgtctaccggactttccacttctgctgctcgtaaacacgccgcaagattctggattcccacatcaatcgaatattccggatcagtaattccgtttggtgtattgggatatctggtattatagccacactcggatgcctgcatgggatcatttccccgcccgccactttcctgcatcatgactgctttgatcagctccacatattcttcaatcccatgctgccttgcatactgacggatcaaaggttcataagcctgtacctcagcactcataggcgttaccgtactggaattactgccacccactatgctgaaaaatgccccgaacaaaatcacaatcagcaaaagcaaaagcacaatccatcctccagccaaaatcgctgtaacaagactttttgttgccccaataattactttagccgctgttgctgttgcctttaccgctgtttttactccctgtactcctgctgttaccgccttcctagcagcaagagttgtccgctgtgtagtatgaatcgccgttcttactccctgctgcgtcattcttgcagttccttcggttgtcttgatccgtgtatgccctgtctgtccggctgtttttaccgttctgcctgtccctttgatcaatggtttttccatctctttcatagaaaagtggaccgttttaatggttcgttcctgacgattccacgttttgattgttctatttggagctttctgcatctgcaccacttttttattgttcgatcctactccggcacttcctgctaaatttcttttcctcaaactgccttcttgtatctcttttttggccctttctataccactctgccgatttgaccgatttttgatgtgttctttcggctggtaaattttttcttcgcctgccgaagaaaaaagaagcagaagactctcccggattttttcggaagtcctctgcctctttttttaactgatatcgtcccttgaccgcataaaaaactttttgcccttgttttcccgcctgatacaccgttccctttacagctctctctgtcttttccgttacctgctgtttggcatactccactgggtttgtctgttcccgcacctgtgtctgctctgcctgtgcctttgtccggatataggtatttttcatatgctccgccgctgttactgtcttattcaatactttaatatccttatggatggggcgtgtcttgatactttctgccatcgctaaacctcctcccggatatgatttctctcacagtttttttgccaccactacaaagcggccatttgtattggaatactcacaagtagaaagcgttaagagtttatctccatattccgccgtcaccccggtctcatacaaagacaattctttgcactgctttacataatctgcaaaatcttcttctgtttctgcataggaaaacaaatagtacggaaatcccgtatcgttataaactgtcgttttaaaaactgccagcaccccatattttcctgtttctgttagagtatcgaaacggatagtcttatgctggtgataaaagctcctatcctcatactttaataaccccgtaaacatagagccattattcatgtgatgtccatagataattacattatcgcttggctctgacggattacaatgttccgcaatataaggaactccataagcactggattctttagaaaaactgtgtttcaaataatagtccggcctgtccggagtgtacataaccggatagttgattggtgtatcctcgatcttgatccatcctgccatatcattattttcctgaaaaagttcctcatatttctgtaagggagatatgggttcctctccattttctcctgtttcccgttgcggttcttcctctgtcattttctctgcctgttctacgctttcagctaaaagagaaaattcctttttcgcctgtttcgcctctgtataatggcagattacctgatagaaagaaatgaaaaaaagcaggctgcaaaccaacagtcctgccagataccattttccattaaatctttcgtatttcatgtcgtacacctcctcgttctattctctcccctgctccttgattggaacgggaagctgtagctacattttcttttcttccttcagcttttttagttctcctttgacagaaggtttctgttcctctttctgtgcaactgttccagccgtttcttgatcccaatggcagtctgttccatactggaaaatctgccactcataaccaaaaaactttttatcattttatggataagcccccgatccggtatctgctctcctactgcttttacttcttttccagtcagaatccttccgatattttttgcaggacttcctgcaacgtgcagttccttatttaatgccgccatctgtgctacacgataagtcatatcttccgctgcttcatgcaatactttctccatcaacataaaagcatttgggatcttcatagctatcaccgcttttcttaaagcatctttccctttttcccgaaaagcttttaccgcattttgggatgactgcaaaaaatttttccgtactctatcaaattgttttcctacttccaaacatttgccttctgcctgattcacacattgtcgaacagacaatttctctttactctcctgcatctgctgaaactgtccttttacctcccgtaattccagaagtacttgtccaaactgttcctgcatattgtctaaatagtttataagagattctacttccttctgttctttttttaatccctgttccatcaaggtctgcaataaatcctctatctccggatgttcccttaatgcaacatttttctttgtttccactctcgttccctcctatcgctctctttgctgtgtctgtggtttcatagctgacacttcccggcagtaatctggatatttcaatcggattgcttcaaaaaaatacggagcatacccgcaatcaaatacttcatagggtgtagacatttgctcctctcctggttctgtataaccattccacaggttaaatgcaaggcgtgtcagtcggatagagccgcccgtctgccagccttcatgaatcccttctggtttgatatgccgtttttcaaaatcgaataatcgttccacatttcttcttgttgtatccgaaatacctacacaatagaaaaacgcctgatggtagctgtccgttcttcccgctttacttaacattgtatagaaaaaattttcatgttcctttgactcaaattttatttctctcatagaaactcctttcccaatcgagtaggagggaaatttaaataaatttcccgacctctcacaccaccgtgcgtaccgttcggtacacggcggttcaatcaatttaacaagtgtcacaccgttcggtgtagtaatctaacattgagactagtccaaattgggttagtctctcttttgtaacagccatattcattgcaccgccttggcacacgcgtgctatatgagctccgtaatacgctgttgaccatgcaaatttcttgctaatcccaagtttcttcaagttctttgctctgttctgtggtgttttccaatgtttccaaatgcacatgcgaaatctgtaccttatgtttttgtcgagtttttcacaaagtgttttcatactccctatcttgaaatagtttatccaccctctgataagctgattgagtttctccaccttgtaactgttgctaacaccccagctacggcatgtcagttctttcattctcttcttaaacttcgctactgattttgcatgcggtttcgccttatactgatgtgctctcgaatcatagtaaaatccatatcctaagtacttaagccctttaggtctgtctactttactcttggtcatgttgaccttaagccctagtttctcttcaatgaatcgtgagatatttctcataactcttttggcagacatttcacttccgaccatgatgatacagtcatctgcatatcgtacaaagtgtagtcctcgcttttccatttctttgtccagttcatttaacatgatatttgccaataatggcgagaggtttccgccttgtggtgttcccacaatagaatcctcatattcctcatctgtcatgattccgctgacaaggtatttcctaatgatagagatcacatctccatctttaatagttctacctatgatggtcataagcttgtcatgatttactgtgtcaaagaacttttccatgtcaatgtctacaatccaatcattaccatcattcatcatatcaagtgctgttaggattgcttgctgtgcacaccgatttggtctgaatccataactatgattatggaactgttcctcgtagattagtgtcagaacctgtgcaatggcttgttgtatgaatctgtctgttactgttggtactcctaagtttctgacaccaccgtcaggttttggtatctccactcttcgtactggttgaggtttatattttcttgtcctcagctgttccttaatgctttcgccgttctttgcaaggtgttctttaagttctgtgtacttcattctgtccactccctctgcacctttatttcgtacgacttgtagatatgccctattgagattatcgctagagagtatctgctccattagactacttgtttccatgcgttctttccttttccgtctcgcttgaattgaccaccctttccccgattggttacggcagatgttgtctcttctgcaatccagactctactaaaactgattgactgttcaccccttcgctccatttccgttacagaaacttcttcactactatgggctctgctgacttctcacagttcgttgttattaggctaatgaaacctctgtgagacctccatgcttaaggtgcatgctctttccctccatatatccgccgcatttactttactcctacaaatgtgatagttattagactttgttgctttgagccaacttatctctcagagtccagccttatatgcgatttctgtccgtcgaaccggaggtttgctttcagcttccttcagattccatctcacgatggacacccttgctgttcggctatacatttcccactacccgggcatgttcgggactttcacccgttagagtgcgcccatggcgcgcaaactcgaaaaacgcatgaaacattacgtctcatgcgttctctacttcgcttattctttatttttgatgttcaataatccattgcagaagtatttctgcatcaatttctccagatgccaatgcaagaatagtatcacttaactctttctggctatactctaattcatatccatttaatgcaagaaaaaccaacattacatgggctccaagccgtttatttccatcaatcattgcatggttctttaccaatccataacaaagctgtgccgcttttgcctgaatactgggataaagcgattctcctccaaaagattgaaacggattcgacaacgcagattccagcattccctcatctcggattccttcacttcctccggttgtctcaatcaaacgatgatgaagcatcagcacctgttcttttgttaaaataatcattttgcaagtacctcataagcctgcatattctgtttgatcagtttctctgaaattgcaataacatcttctgcggacgctgctttttctttttctgccttgctaaaatcaattaccagataacgtggagcattatttttcataataactgccgttccatactcgtcaaccattcttgcgacttttgaaaaattctgatttgcctctgtaatagaaatcatggtatctgtatctactgtcatttctatgcacctctctttcttacttatagtatatacagattctagctagaatacaacctatttctatttcatttccacattttctatcaaaaaatcttctggttttgtggacatcaagcggtaaatctccgaatttttgctcatctggttatagaacggaactaacgcacttccaatccttgcaagtccatttcctgctctggcattggtaatatatttcatctgttccccggagatatgcagaagttccgccaactgttccctatctgaagcagactggttcagcataacgataaattcagagtttgacagcatagttcttgccgtaagagaatccagtacatactccacattctgtgtcaagctggttgtccaagcatttcttttacggaaacgccgatatgcactatcaaaaaagttggcactgtatttgtgctgcagtaaagtatggaattcatccagaaagatatgtgtccgcacaccattctcccagttttgcgatacccggttaatcatgtggtcagtaatcacaagctgtcccaagtctttcatatcctccaccattccccttgtattaaagctgatcaaacgattctctgtttcaatattcgtcgggtgtgaaaagttattcaatgtaccatctgtgaataattccagcattaaggctaagtcctttgcctccggttcatcctgttcctgaaggatacggcgcagcgtaaaaaaggtggggatctcatactgccgcttttgggaatatacacgttccacacaacggtcaaggatacttttttctttcgggccaataatataacggtcatcggtaatccgttcatacaaagagagaacaaactgcgatttatctacaatcgggtttttatctccgtacccttttaccatatccatcgcatttaaatgaatgtcactccctgcacaaattggaagactcactccccctaatgcctgtactaatggttcatactctccctccggatcatagacaagtacctgatctttggtggtggataagataatcagtaaaataaacattttcgtcagcatggattttccacttccgggaacacccaaaataaaagcagacggattcagcaaatgtccacggtttaccaaaattaaattatgggaaatcgcattgattccgcagaaaatgccacccttgtccatcacctcctgcgtgcggaaaggaatcaagctgccaagactttccgtggtcagtgtacgcatactgtcaatctttcgtaccccgattggaagtgcggttttcatgccgtccatctgttgaaatttcagtatcgccatctggcacattttatttctggctacggaaaggatcgttgccgtatctgcatctaactgtttcttatcttctgccatgtgcattaaagtcacaacggctaccatcatacgctggtctctcgtagtcagatctcgcaaaaactcccggctctcctccttttgcagttccatgtcgtaaggaaccgtagcagaaaaattctgattggcattctgtcttctctgccagtttgtgatattggtttccacccccagcaaacgtgtctgtgcctcgttgacagcctcatccgtaggaatcggaatcaagtcaatactgatcatcatattctgattaatgtctgcaaattccgataccattgtgtcgggaatataagacgcataatccttcagatacaacacccgtccataccgttcccccactttgaaatggtctttttcaaattccatcgtatccgggcagatataatctttaaagctatgtcccaatcttgcggattgctgcatatcaaaagagaaatggctttcttcacctgcccggtaaaaactgtacagcacatgaagtttttcctgtgcgtccagttcctcacatttagaacccaagttgctgaaatgggaaatcaaaccattgccggtacgcaggaaataatttcttgcatcctccacatttttccgataaacggaaatggttacatacaattcccgtatcataccgttcgcccctatggttttttccatcagcatatcgttcacttctttccggtatttatccaactgatcttccatcatgggaaggaaaaccgcctctttcagttcttctttattcagcctgcggataataatcgtcagctttgtagtagctccgcaatcaaaaaagttcaaaatactggtataatccaaaaacatggatcttttatcttcttcagacgctacttcaaaattaatatccgtaaaccgatatgttttcgcatatttattttttcctacaagaaagataccatccttccatattgtctgaatcggaattacctgctgtacgcttttgggaatcttaaatttctccctgtcctgccgcatgacggtttttagtgttcttaacatttttacccattgcctccttttcctgttttttcctctcctcttttgtcaattcgtaataaaggttttctggccggaataccagatactttggcatgaggatctcactcttgatccatacccacaaaaatttctccgctgtcattccatgatatttaataaaaccgattgccgcaaaaggggcagctcctaacacacatacccaactgaccgtttccattcccatatgcgggcggagcaaaaaataaagaccaacagcaacgccgcaggccagtacagaacaaataaactgccggagcgacaatccaaaatacattgcctccgtatattcccggatttcccggttaattttaatctccaaaacaattcctcctttttttcatcgcacctttgtctcccctccttttccatgctatactgaaacaaaaagcagaaaagggggctttcctatgccgtatacactgatgatttctctcggtatttccattcttcttctcattctctctctgctttttcggcttgccggaaaactccgtcttacgctgccgctgctctacttcctgctgactgccaccttcttaaataaatgggcggctgcacatgaaacacttgcttttgtaattctctatgtcctgcttgccttttccgtcataagctggctgctttctttaaaaaatgccattcgtgaccgaaactactacaaagcaatggaagaagatatgagctggcagattgatcgtgccagaaagaatggaatcccaatggactccgtttactttgacagtgccggaaatatgcggtacaaagatacggacgagattgtagaatgaggacacgattttgtgtcctttttcttttataatcccatcatttcccgcactacccggtctgccatcttcactgccccgaccagtaccagcatattaaaaatcaattccgcaatataactccacaccattgtcactgccgcagcgtcaggattcgctacagggggagttgccgcaaatactgaaaagataatgcaagccagcacaatgatcgctccttccagacacaccgctgcataggatttcaaaaaactttttcccacattctgtgtgggttctcctgcaaaggtagacagtggaaccggagcaatcgctgtataaagatataaacggaaaaatcgtccatatacgctcatgatcataataaaactcagaatggtgataaataaacctccgattaacgtaaccgcccataagggaatactctcaaaaaagccgcattcttctacggctgtcacaatttcctgcggcagaactgtttcctgcgtactcccaaacccggcggtattcataatcgttcccacaatcccctgtacaatatcaaacaatgccatcatcaactctagtccataggtaatgacacctttggctaaagcaaaacgtacaaaaagtttcaaagcatgttccggtcttttcacttctgcaaaactgccgcaggtctttaccactcccaccacaaaaaacaggactaataaagcatagccgattgcctgcaatgcaccatgaatccccacaatgacattccagataccaccgcctttaaattcttccggggattgggtaatgatctgccagatttccgcaagtttgccattccatgtgtcaagggcgttctgaaggttttgaactacccagttatcactcaaaacacattcctcctttccaaagcggacagacacttgtgtctgcccgccctcttcttatcctctctccctttcctgcgttttctcccgtatcactccataaacatcgtccacaaaacaccgtccgacaaagggattgaagattgcatggcactttacaccgttatattctgccagataatcattgtctcccaacttctttacaatcgtagcctctgccagcacattcgtttctccccttttcagggaatgaatatagcactcacatttcattcataattcctcctgtgttcagcctgtaatcaatgtcaggatttcttttgcaaaagtaataactacacctccggccagcgtcaaaaatccgtttgctctctgcgatggatcatgggattttagcgacaagccgatttgtacgataccaaagcccagcaaaatcataccgatggcccggatcaaaccaaaaataaattctgacagattattcactacggtaagtggatcgtcagcagcaaataccgtcatcgttcctgctgtcatgaccagtaccattgctgcataaactgccataaactgttttcccctatggctcatgggcaatttctttgtatcctttttctcatttctgtatttcatttctttgaatcctccttattgtttttaaatatctcctctaaatcctcttcggacaagagttcatagctttccatatccggttcagtttccgtaatctcaccttccagactatttcccaaagtgatgcctgccaccgcctgtgtaagttctccatgcagatagggttttccctttccatctgtggtcaatgctacatttgggtgtttcaaaatatcaaatttttcgtccataaccgggcgttctccccggataaaaagaagtgcgtagcggttgtccagcatacgcacttcatccggtgtcatcagttcccggcctgtgatctgatagtttgtggaataattcccggagtgtccggtggactttccgtaagtgttggtatcaatggtggcttttcccagcaattcactgacatacttatgagttccctgctcattgccccctagatataaaaattcatcgcagttgccacaaatactttcccattgcttttcaaacaatgcttttaactgcgccagattttgcaggataatggaaacgctgacctctctggaacgcataacggaaagtatcttatcaaaatcatccggcaaactgaatagcgataggtaagcctctggtgtttccacctcgggcttttcccccgctccacaccgtgcgtgatagtttcccatcacacggcgttccaccgactaagattactttttagtgcctatatagtcctcgaattgtatttcctccaactctctgtgttttcggagtttattgattttatctttcatttcttcggtcaactgtaagtctgtaagcaactttccaatttttacaggattcgttgctccaaccaattctgacacctcttttgacaggataatcaaattcctgtaagtgtcgtttcgctctcccttacatggtttgatatgctcacataccatatctggtattgacagggcattgtgcgttaccgcacatttgcctttttgtgcgatatatctcgaaagagcgttgtctgccatctccaacgtagggtagagatgtgcattttccaccatgtatttcataacatcgtagctgatacagttttcgatgtctgaatacttcctcacatatttattgacttcacgccttttatatttggggtattcataagccacatatccaacagggataatcattcttccctttatccatcggaactgcttagactttccatacttttcctgaataaacttgctggttatttcgccttgacgttctatggggtaacaacggttattatgattcatgccgttgctttttcccattaccttaaaggcgatttccgcaaagtctgctgataccatagttgccatacagtaatagttgtgcattcccataaccattgcattgtaaagacttatatttcggtctatttcgctttgtttgctcggattctttatatctttccaaacgtcgcttagctttttgatgaccttcgctttactcttatctgccatgtgggaacgtattacccacttactgccttttggtacaaccttaaatttgataccaagaaaagttgtataattcttccgcagatttgtaatacccgatttttcttcactggtctgtaaatgcagattttctgccagccagagttttgtggcacacattacctttttcgccgttgcataatcccgacagaatagcttaaaatcatctgcataccttacgatatacatttctttcaaatcggtttttactctcagcttattccatttctgcgttctgtctactgtgaggatgtttccctctttatcagtcttgttaaactctaaacctgttttaccctctttgattttgaacatttcccactgactggcaatccaccagtccagttcattcaatacaacatttgcaagaagtggggatagaatcccccctgtggtgtacccgtttcgggagtgatagtaatgtcattgaacaggatttccgctttcagcatctgcttgattatcataatcagctttctgtcctgtatgccgattccccacaactgccgaatcaacttactgtgatcgatattatcaaagaagccaacaatgtctacatctactacaaagtgcagattctgcaactgtgccattttatagcattgtgcgattgcattctgcgttgaccgatatggtctgaaaccattgttccgctcatgaaatttcgcttcgcaaatcggctccagtatctgtaagatacactgttgtatcagtctgtcccaaatactcggaatccctaatggacgggtttttccgttgtctttcgggatttcaactcgtctaaccttttttggctgataatagttcaacttatttctgacggttttaatgaccgattcgatgggcagtgactgtatcgctacaatcgttttcccatctgtgccgggagttttgctcccactgtttttacagatatttcgatatgcaagtatgatattctgctctgacacaatcaacggcatgagcctgtcaaatgtcattccattctggctgtcctcaaataatcggtagcctgtttctttagcgtcatacctttctgcatttcgctctgctttgtttacaattcgttttgccatagtaaccagctccttatcggagaatgattttttcttagtcgcaccacgacagctatgaaaatctccattttagtgattactatataggcatgaaagaaaatcttagtatcggcttgaggctatccctccaccgcttattatcacggcttcacaggtactgtgcctctactctcacagccactaatgcacttattatagaaaggctctttcaatccctttccttttcgatacaactacggtactttttccgctgatacagtcagctcccgtattggctgctttccacgttccgcataacttaggattgttgccacttaggtcgttcctttagccctgcaagcattatcttcgagcgaatccctcaagatacctgtgtcctgtaaacacagagggcatttcatactaacaacttttactttgccccgcttgcgtacccattggtacacttgcatttctgcaagccattcgtttagagccgtacattcggaatctttgtcagaccgcctttttggtcattctaaccatatggcaaccccacccgcactgtcacacacaacccgtacctctacgaatctttcctcgccattaaacgttagggtgtgcttcgcacgacttccccgagcttataaccccaaccgtctgtattcggctgacgctattcggagtattagtgaatccccttcagggcgttaccccgtcatttgagatttcagttatgcagttctctaaaaccacatttatttaattgtttgtgactttaggctacgcttttgtcggttattcccaccgttttaggcgtagaacgtgtcacaccattgtaggctaagcgcccagcgccttactgtctcacaacagcaggtttccgaacactcgcccccgaaccgcacgtacacctctcagtgtatacggctctccactacaatcctctacttttatttgtgaatcttgttataacattcttcacacactacaagcgttttcctctgtttcttctgcatgattgcaccccattctgtcatcccgtccaagtccgacaggcttctcacctgatatacttttacggattgcacatatgcaccacacatctcgcagatgttagccttatatctgtaaaataattctttaggcttgttcagatgcccatattcaggcacgatatccacataactccccaatgcatactttacttttcggaaacccgagttataaagagtcgcatatttcgtgccgttctttgtatggtatggtgctttaaattccttgtttttggtaaatttcagtttcgcctttgtcattgtcattcgatatttcgccgctaaggttttatacagactgtattccatcacataccggaatttattcagtaccgaaacattgcttgccagacggtaataattatagataccttgtatctgggcattgtatttcagcaccatttcccctggttggagataaatatattcatccctctgcaatggtttccacacctctttttgaccggggtgggagactatcttcagaacgccataatccagcagtttccccacccatttctcttttggcaggtacagcttgattttattcatatatttcctgtatgttcctttgccctttaccttcgccactgcattatcgttacacacggtcacgtcatagcctaaaaatctggctttatccttaccgcttgttatcagagtcttttcctcggaaagctccagtttcagttcctttttaaaatactcctttatatgggatttaatcttttccgcatcctctttactcccgattacaccgatgataaaatcatcggcgtaacggacatactggatacgcttatagttttcatccattgggtttccaataggatatttctggaactctcgcttcagctctgctttcttttgcagtgcggctttccgctcttcctccgaatatttgccccattcttttcttaccttatccgcacatgcctgatgttgaattttggctttcatatattcagcgcttttctcccgggcttcccctttatcaaatgtcttcttgtagctctccatataatggtcgaactcgttgagatagatgtttgacaaaattggacttatcccggaaccttgcgctattccgctgaaagtagcgtgatattcccatttttccagataaccggcatgaaggaacttccagataagttctataaaagcttcatccttgattctcctccgcaggatattgataagattttggtagtcaatggtatcaaaataggattttatatctccctcaacaaaccatttaattccagtgaagttatgttgtaactgcatgagagccgtatggcagcttcgtttcggtctgaaaccgtgggaatagttggagaatgtcgggtcatagatattttccagtatcatttttatgatttcccccaccagtttgtcgtctgatgacgatattccgagaggtcttagctttccgcttttctttttgatgtattgcctgcggacagcttttggctgataactatggtcttttagtgacgcaatcaggcgttccactctttctttaccaaacccatcaagggtcagcccatctatgccgggtgtcattgcccctttgttggcatagatgttttggagagcttgcaagtagaaatcttcgttataaagattccggtacagtctctcgtacttgtagttttcctctttcgagtgtttctgtagattctccaaaataacttttggacttctcatagtgtctcacacacctttcctaaattattttagtgttgtagctgtcccccttcgccatgtgtacggcattaccgcctcggactactacggggactccgtaaccattccggatattcaggcactttctgccatagcttcttagaagcgttccgggttaggttatcctcgtttagacttgcttgtacaagcttgttatgttgtgggatacgactttcgccattttccgcttattgcggctggtcagtgatgaatgtgatgtgtagcacagttcgcgcaactctgtgtacaccattcactgcctaacgtaaataaccaccttccgttagtgctgacgataaagcccctctggctgtcattcaagcagtttagctgtttatcctcatacataacatttcatctggatgcccgttcacagcctggtgattggctgaatagcacctttaccgacatgctgcactccccgtccggtttccctttcggataagtcggttgatgataggagtcaaatccatttctggattctcacattgaacctactgtcttgctaaagacagattacaaacaaacccgcgtggcaaatgagccacttacgagcgcactgcaaattcgtccatcagaaaatgcacatggacaggaagtcggcctccgtatttgtggtctgccagataaaaaagctgttggaacaactgagtatataaaatggacaccagaaagttataactggtgtcgttgtccggaatcaatgcgaaaagtgccactttcctttcccctaaagacggaagatctaaatcgtccgtagctgtcaaggcggcaagactggacaagttgaacttctctaacctcgctgccagcgtaatctgaatagattttaaggttttcgcactgccggaatggtagtccttataatactttacagcgatatgctccggttcccgcatttccagacgctcaaacagttcatctaagggagactggtattcgtcattatcctcccgtacttccccggcacgtaaaagttccataaccatcggaaaattctgttcatctttcggagcctcatatttcagataaaaaatcaaggcaaggagcagcatggacgctgccgtatcccaaaatggatcgttgctctggctcccctttggcgtagtggctttgaaaagattggtcacaagacgctgcacatcgttatcatccttcagataaacaaacgggttataacaaaaacttttctccatattgatcagatccagcacccgcacttcatatcccttttcctctaacagatgtcccgtatccctgagattttctccctttggatcaagtaccacaaaagaggtatttgcctgcatgagatatgaggtaggcaccctgcgccttgctgactttcatcagtaggtttcagggagccgcctcccaaaccggacgtacacctctcggcgtatccggctttccatgaatcaccttgattctttggtttcgtgtaagagttcaaagcagttagggcagagagccagagattttcttctcattttcagcattttctgctcgaatatatccctgcctttcagcgatttcagcgttctcacgtggtgcatacataaatagtctgtatgttccccgcaaatctcgcatattcctgcttttatgcggttgactatcgtgtgcctgctgtcatatttcctataactcggcataacgtccgccacattgtcatagccgtcgctgtgctttctgaatccatcatggtaaaattcgcagtatttacgccccttagttgtatcgtaggggattctcaatactccgtttaccatgtgccgctttttaataacactgacattcgttctgtgctttcctgccagagtttttaacatgctgtaccgcaccatgtagtaatacttgtgcaatgtacctacattttctgcaatccgatagaagttatataaccctcgaatttcagaattgaaagtagacacaatctctgcgtcgttgcggttcatcaggtctttcctcggcatgggccgccacatttctttgcctgtgtcattgttgcgtttcacctgtatcgctccccgttccattgcctttttaatccatttttctttcggcatatacaggaatacttttccataccacacccgtttcatgtcgccatttttacaccgcttcatgttcttggaatggattactttgaaatcgtaccccagatagcgtaccggcttactggaatgggtgactttcgtcttttcctcggacatttccaaatgcagtttttcttggagaaagatttttacatcttctttgattttttctgcgtcctttttggagccgataacgccgattacaaaatcatcggcgtaacggttgtactggattttcttaaagccttcctcaaacggattgtaataatgctgattcatcttctcccttctggaatccttaaattcttttaccagttcaggagttgatttctctgcgcccattaacgctttacgtgcctttttatatctccgggacgcccgctcgtattctttggtcgtctttctgcgttctggctcgcagtcatatttttctttatattcctgcatatagttgtccagttcgctgaggtagatgtttgcacatatcggactgatgccgctgccctgcggaacgccggagtaggtgcagttgtactgccattgctccatatatccggctttcaggaatttccagataagaccgataaaagcctcgtctgaaatccttttccgcagtaattcaaccagcacatgatggtcgaagttatcaaagcacgccttgatgtctccctcaacaatccatgtaatacccgtgaaatttttcttcacttgcgtgagtgccgtgtgacagcttctttttggtctgaaaccgtgtgaattattgctgaatgtcggctcatagattgcttcaagaatcattctgaccacttcctgcactaacttatcgtcagtagaagtgattcccaacggacggagtttcccgttctttttaggaatatactttctttttgcaggctttggctgatatgtcctgttgcgtatggattcaataatccggttaattctcggcaggctcatgttgtccagtgtctgcccgtctaccccctgcgtcatgctcccctgcgatttcgcaatgttcgcgtatgcaaggagatagaattctggattgtataagttgcgatacaatctttcatatttgtagttacttacacttgccttttcttcaaggcttttcaagacatgaatcggatttctcatagtgtctcgcacaccatcctttctgttttgaaaatgattcactgttcccctttgccatgtagacggctttcccgtccgcagactactatgggaactctgttgccatggcgaatattcagaaccccgcatttcagcgttttcatagcctcttggcatttcactttaggcaatccccgtttagtacggtataaataagcgttccacgttgtcggtatgtgacgttcgcctttttccactttcccgtggctgaacctgctccgagtatcagcagccgcatagccgaacaatgcaactgtcaggaacactgacgagtacaacctctctacgtcaggggtacgctcttggtcccgatttcaggctgtcattcaagcagtttagcttccatcctcatacgtggattttcattccgtcacgccggcgcttctgaggtttcagcgccccgtgtcctccgtcatgctatggtcgccctccggtttcccttttggggtaagacggggaatgatgggttgcggcacaatgccgcttgatacttttacctactacttgctcaaggtaggatttataccgcccttacgggcgcactcggtttcgcataaaatctggtcttgcctgccccgctgcccccgatcacaatcgttaacagattcctgcggtgtttccggctgttataactgatttgtacgttctgcgtcataatcttatttgccagaaacgttttatcgctgtattttttattgactgtttttgcatttccccataccgctgagccatgttcttcgccctttcggtattttctccgggtagaaacatagattcccagtcccattccatacgcaagtaaaaaaagaaggacagtttttacgctgtccttacagatcagaatagaaaacggatgattcatggcatccggcagtccttttatcactcccatcagtccatctgacaaatagggcgccgtcaaaagtgccagccagaccacaggaacaattcccaaagccgcaaatattcccatactttgtttgctatcgttcttcataatgtcggtgtcctctttttactttctccggcggcacttccagtttctcaattacttttaaaagcacgtcatccactgcatctgtgggacgttcttccttcagcaactgattccgtttatctttcagagaatggaaaataataccacactcatacttatccagctccagcattactctgtcatcacgcattcttccctcctcctatctttcctgtgctgcctcccggttctgtcctgcctgttcctgatgacgctggctgctccgttcctgctcaaataccttggacatacgggaagaaatctggtttgctgcgtcacgagtcttggaaagctctgcccgtacctcctggggttccatcccctcaaagaatcccgacgcataactaaaatcatatccttttgtgtccatgccatactttttacttaatagataagaggcacaatatgcatggaacgcatcttcattacggtcataatccggatttccatctgcaaaacccgcaagtaccagctccggtgttaagcactggaaaatttcctgtgcgttcatgcctttccgcacatagatacaattttcttccggttcaaagaaagcccctttatcacttggcatttgttctggatcggctgtgacaatatccgctggaggattactgataagtgcccggatcagcagacgttccccaactttttcctgcgtctgttccagtcctttcatactggtctgggaaatatcatacagtttttttgcgttataatacgtcccgatacttccatcttccctttcatattctttgcccggctctaagatcagtaccgggttctggcgttctgttcgtttcacataagctccctgctctctccagtacccgtaatctcccagtttttgtgcctccggacgctgtgctaagatcagcagggcattattcgccgtatagcggtcaaactttgcctgcacatccaaatactgctggaatctcccactatccgttgccacttccgcaatgacctgctcagacagttcataacagcggtttcgattattcctgctttctgcaataaaagctgcttttttatcatcttgtgggactgctgatacatgcagcatagaatcaaagctctgttccatagttctttacctctctttcgattttgcaattttctttttggtttttggctgtgtgtgctgcgtctgccgattggactgcggtctctctttagaaacaggttcttttcctttctcctgttccttcttccttgccgcttgaattttctgaagttcctttcgcaccgacggtttttccggtacaacaggtcgatacagtttagaagtatcccctgcggttttctcttgcctccctgagataggctcggacagacgggagttctctgtctttgccaaagaggggtttttctgtattccctctttttttactggttccccaaacaattcgtccattagtttatcttcctgcgacttctctggatgttcctgctgcggaacattctgtgactgtccatgcaatacaagattcttctcttttgacttctctgatacggtagaaggcgattctctcgatccctgctttttatccttctcctctgttggatgcagcttttctgctctggatttttcaatctccgttttaatctgtgccgcctctgtgacagacgcaaacttaaaccgttctacaatccggttgattctggaagcatcctcttctttcactaccacgtctaccaaaccatctgcacttcctcttgggtttctaaccgcacagtataaaaccccatagcgtttcgcctccgtaacaaactgctttaaatcgctttctttcacagaataaaccgtcaatggttttccggagcgaatcagtgtctccagccttaccctgccttttgtctttttctgttcctttaaaactgcataaagcaggacggcaatctgtttggctccggctcctgtaatctttaaagctgcctcgccgacttccattgaaatccgcaccacttgatcagcggcctcgcccgatgtgttcatgctttctttgctcctttctctctatggtttcctgccgcactatctgaattttctgttttaagattccggaacgtgcagcaattccgtcacaaagcaccacctcctttctgagtaccccaatccgggaagtcaattcggaaatttctgcctttaccttctccctcttttcttcctctctgatatttctggactgataccgcaaatgttgtcgctcatcggatagctgctttatctgtgtctccagagattctttgtacgaaaaaagctgctccgcagtctcaatatgacagcggcagagcagccttgtttcctttgaaatctgttctaattttgttaaatcttcccgcaaaagaaaggggagttgacggcaagaaatcggcggacgattctttggcagaatccctaacaggaaacaataatgcagatataagccttgcaatcccccgatttttcttttcggttggtttcctgccacatgaatggtatatcttttttgttccgattgtaatttctgcttttctgtaataggcggtttttcttccagtatcctgcggcgaatggatttcagcgaatactccttcccaaagttccgttccagtttcagtcctctctcccttccctctggacgtaccgtaatatctttccccaacttataaaaatatcctttctcctttaaaaagaagaaaaactgtttttctgttcttgccctttggatggcatcatctacatcttcccggacaagactatggtaattgggaagtccttctttctctgctttccatgttccataggactttcccttccctttttctggattttgaatcactgataggtgatattctttacaaagccgatctgatacagcacgcatatcccggtaatcctgattgctccgatgataacgttttccatctgcaaaggaaacagaattaacgacaaagtgattatggagatgatgagccttatctaaatgagtggctaccagcacttgaaagcgttctccccaaagttcctctgccagccgtaccccaatctcatgtgccattgccggagtacattctcccggtgcaaaagactgatacccatgaaaggccatgattccttcctcttttccataccgtttcttcactgccatcatttcacttcttgcagtggtcggtgtgcagtttacaccggaaacatactgctgcatcacaaactcctgttccagtgcaatctcctcttgcccttcctgttttctccgtctagttttttccacattgactgcataagcaatcacatccaaaaggctctgcgtatcttccagtgttctttgattctctggcaagtttacaatctccggggcaaccgttttctccgggttttccacatagatcacaacttttcccagccatcctttcacgctccagattgaagtggtcgccactttaaaacactcctgtaccatttctgttgtctattgtcatcttctccggtaaaacaactgcctctgtgattttttgaacagcatcttcaaactgccgcagatccctgtcataccgctgtacatcaatgacatttaaaacatgagctttctgtgcgatctggtttaggttattcccgattcgatgaagttctctcatcatagaataataatctggtggcggagtatccctcggaactactccactaattaagtgccgcagatatgcttcccggttcaatccgcttttcttcacttttttatccagtgcctccgcctcttttcgattgagacggaataaaatcgccacgtttctttttctcatcgctctctatcctttccccgttctacggattccggtatctgacaaagttttttcgtttctttctcaaactcatacacccggtctgataaaacttcctctctggataccgctttctggtttatctcacgcaccatttctcccatctcttttggtaacatttctatatcttttggaacaataatcagctcatgcagggaagagggaagaatatagcacccctgcgggaaaacagattctaactgctcctgcagattgggatatgccagtacagaagcgccatccagccccattttattacttaacacatacattccttctttggggaattcctctccgctttctagctgtaataaatttttcctttccgaaggcatccccatcatttccatcataacagacttcatactcactaacacaggcggtttgttacagaccgaattatccattgctttctggtaaacctcttcaaaatctacgccccattgtctgatgatttcatgggttactttgatactgccgtttccctcattcccctgcatgggaaattcaatccggcaaattgcagacaagtcttccatatctttatgtgggacttcccgcagcatccgttgatttgcttttgtattgataacctgtacagccagataatccttgatggaatcataatccagaagatccagactttccggtaactcccgcaaagccaaggactgcttacatacatcagcaatatggtccataacctgattcatcgactctccttttcgaatctgatcataaaaaggctccatatagacaaccggggcaatcttctgtcccagcaggctgaagataactcctgttaatgccaccccgttatttttctgctgttccgtaactttacattccatgttctggtattcttctggcagatactctttaatctgctgcgtcacgctctctgcgaacacttttactgctatcatactgtgttccctccttcccttttatcatatgctgatattttctcagcctatttccttctgtctttttttctgttctcatcatttccatacgtatcattcgtctacctcccggtcatgtttgtacaggcggttgatctgcaacagacacatcatagccacaccgaccataccgccaacgattgttccacaaataaacaaaatcatctttctacctccacttctttcaaaaggggttcagggaatttccctgacaagctgccgcagggttgccagataaaatctggcaatccataggcgttgcttgctggtattgtgtatcacacgacacacgttttctcgccctgcctccggcacatcattacctaccgaaaaaaatctttcttatacccagccttcctttatcgctcagagttccgttccgtctgacggttcagatttttaccaaccccacttacttgtcggcaatactctggctctttttcttcatagatttcatgaaaaaatgctgcaaatccttctccactgcggcgttctggtgcctcatctataaagtcacaccattgtctgcacgcctcttctaataccatatcgaatacttcttttctctctttcttctgtatcatatccttataatccatctgctttttctccttcactttttgctttttccaggttatctttcacactctcttgtacgaatctgctctttggtttgaaagcttaccccttgaaaatggcttgcgtccaatacatacttactctctttccacctgctttccgcgatttcctccgccttttcccgactgtttgcccggattggaacggtcatctgcaaggtttccgtaatcgtcacatcatatgttttcatcgttcgattcccctttcttttgttaatttttcccgtctggtctgttggattcctaaacggatacagaggttatcattacagtcttttccctgtctgggcggctcattttgagtgcggtaagtttgaggaagtaccgtctgtatcgcctgtgtagcaagccttcccgtccggtcattatcaaaatggaacctaatctgttctacttcccgatattctttcaggaatctggataatgctgccgggatcttactttcttcgattcttttggctggctgataaactccggcaagggataacaggtgttcttctctccagtttttcccgtctagctttcgctctgtggcatatgatagcaggtcgattgctgactcatacaagtgtacaaccgagcttgtctcttctgccggaatgcagaaagaataatttttgtcactcccggctgcctctccaataaagtctgtttccacaccacgcaaggccgcataacggggtttcccttctgtatccattcctacaaagactacattatgataacgctcgctctcataaatccgtccggtttccacacaaaactgtatgattcccctgtcaattcccctgcgttccaaataagaaactgcatatctttcattcaaatatggtttgggtaaaatcagttttctttctgttttcttttcagtatcaacagaaaaagacggatgaaccgccgcctgtcccgctattgtctgtactgcctctacaaagtcatatcccttcactttgatcagataatccaaagcacttcttcccccgattcctctgctccaccacatccatttcccattggaaatcttcaaactgtcatgggttctggtggtataggtattgcctgaaaagtgtaccaattcatatggctcataattcttcagataagtcaatagatccatctgttttactttctgcactatttccggtgcgacataaggcatttttttcatctcctttcctgtcctaaatttgatattttctttaatttttaaatatctggacataaaaatagccaactgattttcgttttgaaaaccaatcggctatgtacttttaatttattattataatttaatcttttttcaaatccgctgtttatcttataagaatatccgaaactattgcctttatttgttcatcatcatatcctgcatgacgtaatacaatacaataattaatatgctccacaagacgaaccgcatcaatcgcttttatatctggctgatactctcgcttttcatgtgccagctcatttcgccacaaattagctgcctttgctaaatcagcaacatcctctccaaaccattctgaaagtatagatttcaaagattgccaggttgaatatccttcgtacactttcattattttttcttctagagatatttgtggtcttaatgacttcatgaaactctttgctttctttttcttttttcccgtgacagtttcgatataaccatcaacaagggcttgcatatcattaaaaaaatctatcgtctcttgtgaagatatttcaggtaatacagttctcacatagtattcaaatgttgccgtaatatgcaaactttgttccaaatcaataagatttctatatttaaaagaaggatgaatgctacttccattcaccataggagtatctccaactttttcttcaaaaaacaactggaataattctttgagtttatttgaaaatagtctaccattaggaacttttgcgatttgtttttcatcttctaatggttcaaggtatttctgagaaaagacaatattttgttgtgtatatctaacagtatcaactaatttccttttctcaattcgttttgttggatactctccaataagtatagcagtccttaaaccgatattttgtctattgcaaataaacgaaaaaaaggatctcgcctcatcatataatcctgtcaaatactccaaatcatctgtttccggaaatttcaatgatacctctgatatagtctcagcaatactcctgacatttaaatgtccctccatcttggtatcaaaagaaacggaaactactgtatccgcatattgaatatcaaaactatataaggactcttttatccttgaaaaaacaacttcttgctccgaaatacttgctctacctatagatggaataaaaaagtctaattctgaaaactgtaatctcatttcagtatatcgactgttttcatgataattttcaatataatactcaaccgaacgtatctgatcagtgaatgaaacattttttgacgtttcatcttcaacaagcatactatcattggaaagaggtacacttaatttgtaaagaatattccctcctgctatcattccaaacttttgtccaataattttatccatttcgtctggaactgtaattactcttttcccaatgtaaatagtaattttttcagtttccggttcataacaaaatggacaatcatttccacaaattgaagtaattccacttaattgttgagacatcatcccatctccttcataaaatatttaccaatttttcaatcaaatttattttccatcatcattacgaattttttcaatgatctgacctatattacaagtaatcttgcctttgcaatcatgaatatcctgattgatttttttctcctgtagaattgctatgttgacattctccgctaactctccgatctgagaatttttctttgaattgattcccgttttacttaacaacaaccgataaataaatgtctgattgccctctttttcatttttaatgatttcttctgcatggggcaggatatcctgctcatatgcattttcaaaatgcaataacagaaacaattcaaacgctggatttgtcactgcaagaatattattctgttcccctgcagcaattacttcatcgtaatcctgtaccttttcttcaaaaatgtcagcatcgaatacaataatcatcttgtcacgttcacgatcaaaagaaatctctggattatctttttgggtttctgcaaacgcaatcaattttttaggataactaatatctctgtcaccctccgtcttttccagcaagcgaatatcaatcactggatgtatatttaatgattttctaatatcaatcagcttcttgaaataccatgtttctgtatttgcgccttcacaaataaagaaatatttccggtatggttcttgttgttcctctcggtccgttgttctgctgttccaatttgtataacttctgacaggagccatttttattcctcctctctaaattcaaaagaagaaaatacagggatagcaccatatctaccttctaaatatgctttgctaagcaccttatcatatcgttctttaaacttatctaatgaatagatcttacttgcattttctgcactgcgctctacaaaccatatctcatctcttctgaaaattgactgatccataatagaagattcatgcgtagtaaaaagtaattgcatacgctgctcactatgcagctgcataaataattcaaggaaacgctctgtcagttttggatgcagacttctctccaattcatccaccacataaagcacatcttctcttttattcaagagcatatccattaagtcgaataatcgacgtgtaccatctgattcttcttcaaaaccaaattcataaaatgatttactatgatgcaagcgtatagttgttaccttcggctcagtatgacctttgacttctatattgaaaaagctctcgtttgacctcatagtcatacggaaagccggatcttcctgttcctcgattttacttttcacatgattcattactctctcaaagacaggtttcggcatcgcatttgataactcatctaaactaatttcctctattttcacctggcttacacctgtatcaaaggtttctattaacttattgattaactgtaaagaatcattatcataataatattccaggtcaatcagcggagtatttggtgtaatcacagtaatatgattttttatccaatcaaacacttctgtgaaaaacaataatttagaactgctactatattttttaccacggttcatttctgttaaaaataaagatgtttcattaccggcaaaatcatctgcataaatttcaaatttattcttttccacatttcccagagttatagattcatccaataccggacgtttgttaccttctctttcaaagaggcaacgtgctgtaccattctggtataattcatagagccattcagcagtaattttccttttacttaatactgccgaaaaaccataagcataaaatttgtcccccactgtaatttggagttcaaaattactttctttctctttattttcttttctgtttttacaaaacatctggacagtctccataggcagccctacctggacacattccttaaaaaaacggaaaaattcaacaagatttgttttaccggaagcatttgcaccatacacaactccatattttaataactgtgtactttttattttaattttatgactgttattcgtacggattttatttgatgaaatcatggttaattctgttgcttcatcaaatgatttaaaattttctatactgattttgactaacatggcaatccacctccaagaacattatattccgattttcctttcaagtcaacttacatacgtttatttagagattttttcgtcaaataagttctttatttctcattattgccatttcatttgaagttatacatcaaaaaactagatataacatatacttcacccaaatattgtattctatgtatgagggagaacttactctccctcatgactttaaacgatgcaattagaaaaatttcatttcatctcgttactgatttcccttaaattgctccaccgccccaaaacgtaatgcctttatttcctttagctgctttttgtataatcctggctcattcacctttcccactcacacgttctcctcgtatcatccagcatattttctgatttaaaactaaacattttctcgtttgttcctccaatgatgatatggtccaacagttcaattcccataagttccccgcattccttaagtctttttgtaatattcctgtcttctctggacggccttatatttccgcttggatgattatggattgctataatcccactggcatttgacaggatactgctcttaaagacttccctcggatttacaagcgaagaattgaccgttcctacgcttactatattcatattgattacctgtccgtcagttttcatattcagaatgcaaaggacttccctgtcatattgtgccagctcttttcccatcaattccacaactgcctgcggggaatctaaaattttctcactatagatagaaggttctttcaccaaacggatattcacaatttccaattcattcatcatctttgtcacctccttctttttcaaattcgataactaataaagtatcttcatccattgtttccacaatattttttaactggctgaactggatttccattcttctccacctcccaaaaatgtaataaattttcctgtttttatcgccttttggatctcattgatcatcccgatctcagttactgtgatccccggcaatgctaaaatatcatccattgtcatatttaaaattgttttttctgtgtcaaatcctgcatccattagttttgaaagagaacgaattgctttatgattcatttgtgccattttttcaccccgtttattctctactgccattttctatattactcaacgtttttttcttactttgacgggggtggcttaccgccacccctgtcgtatatctcttattttctcctgttccgtatattcagccagagcaatgctcccacaataaacacaactaatccaatcgtgatccatgtctttgcgctcatacctgttcctcccctttcttctttctgctttttcttgctgcaagaattccaaaccctgccacccctgcaccggacagggcggataatacgatccaaagtcccggtctgctgtcatctcctgtcttcggtgtcgtaatcacttcctccggtatcttggcattggtcatagtagcctttataatctgtccgtcctctttaatctcaaaagcatactctttttcgtcaatctcatagccttccggtgcgttgtactcctgataggtatatttcccgtaccgcaaaataaacttagcgattccatttttatccgttacccctgttgccacaatattcccatcttcatctttgatccgaaatcctgcattcggtaacaatttcccatcagaaatatccttctttgtcagctccaaggttccagtgatcggctgattgacaaagccaacgcctgcctcattctccacgtcaacaatttttccatcttcctggatttcaaaatagtatgcgttttcatccaactgaaatccttccggggctttcttttcttttacaaaatatccgccataaagaagataatctgtctggtagattccttccgagatttccggaacttcttcaagcagagtatcctgatcggaaaattctttatccccatcgctgtcctgataaagttcaaaaacagctcccgtcagcttatttgccggatactcagcatctacctttgtcagacgcacactgccctccatcttcttgttgaccagttctatctcaatcacttcttcctcttctgtaaccgatacataatggagtgcctcatttaacacatatccttctggacttgcaatctctcggacaatccatcttccaaagggtacattttcaaaagaaaacgctccgtccttaccagaagtagttaccattaaggcagtttcttccgtaaatttctctgtacctgccgaaaacagaccgatggttgctccttccagtgctcttccatctgcatcaactttgaaaccggatattttcccccggatcaatttattctcaatggcattcccttcgtgaacggatatatggacgactcccgtatcctgcccctgataggtaaattccaccggatatttttccccagacatgagataatgctgatccgtagccacttctttcacataatattttccaaaaggtaaatctttctggaacgtagccattccatcttccttacagaatacaacttccagtaaaccatctttcggaatagaagaaccgtccgctgcggttagtgtttctgccacatacagtccaaaagccacgttctgaatctctccctgattcccaatcccaaacgtctcatcctgttccagtatctttgtcagatcaatcttcactttctgtcgttcattataaaaagcggtgtccgtttccgttattgatacttcctgtcctgcataggttaattgcacttcgtgaatttccgggttcagcaccataccgtccggtgcggtcttttctactacctgatacgttcccagatataattctttcgtctttgcttttccttcttcatcggtagtaagagtgtctaccacttccccggcagctgctcttatcgttccgtccggtgtcacaatatcttccgcagcgatgacttcataaaccgccccggcttgtccggtcactttgtaaaccggagtataaatgttttccccttctacaagattgccatccttatccactacgccgtctccagatacctgaaccgaagcaaattcttccccagtctttgtcaccagaatcattcctttctgcggcatatcctgcttttctaccgtaatgacggtgattccactttcctctcccgactctccttccgctatagtaaatggaattggggtgccatccagcacatatccataaggagcctctacttctaccagggtatagttcccatatggcagtgtttccggggtaatcagatacccgtccttccctgtataaaacgtatcgacttctgtcacttccggataagtgtacttcatggtcacgagtttccccgattcgtcataaatctgaaatcctgctcctgcaagtggaatcgtctttccggtttcagcatctttcttcacaatcttcagataagactcaaactgacggttattgatcagatagcggtaaatatgcccgtcacgctggataaacacatcaaaatcatcgatcatttcccgtccttcccagcctttcgtctgatggacagtataaatgccatacggcagggcttttgattctgcatagccattctcatcacaaactaaagtatccctctcgctgtctttggtattgtcatagctgcccacacttttaagatagatctggaactctgccccttcctccggtgtttcgatctgggtactgccatcatctgtatgcttgatgatcgaaatctttcctttcagtacctgttccgttacatcattggaagttgtattcagttctatggtataatcctttgtctctgcccctacaggatagatggtttcgtctaacagatacccttctgacggggtgatttcccggattgtccagtcatctccacacacataatattttgtagtaaaacttccgtttttgtctgtagtgtaggtgtctatcaattcttctccccggtaaatcccatacactgccccagcaagtgttgcatctccctgcggagtttctgtttcacggtcagtttttatcacgatcacccggaatttcttcagcacgttatgaaaggttgcattggtcacatccttccagttaattgttacgtcttgtcctgccggaataacataacgatctgctgtctcaacttcttccagtatatacggtgtatcgccagaaattaaaatatctgaaaaagttgcaactcctgtgctgtctgttaccgcatattcatctactggaatcccggaaagagacgtaccataaagatgaaatttcatgccttccaccaatccatcctcggaagtctttgtcacttttaaactgcctcgtttcaagatgttggagaaatccacttttgctgtctctccaccctttacttctacctgttttgactcctgtggctcatatctgtcctccgtcagttctgttaccgtataagttcccggctgaagattttcaatcttgatcgttccatcctctcctgtggttacagccttgtcgataccatttccggtgacctgaaatctgagtccagccaccacaccgtcctcggaggtcttcacgatctgaacgtgtccgtaaggaatcttcacattcagatatgcctgcactgctgctgtattctctacacctgtgactacatcctgtaaagacggatctccataggcaatcaatttagcactactgctgactgttggtatttttttcgttgcagataactgcacatttcctgcaatcgctttactggatgtgatggtcagagtatttccggatgtgctgacttttacctcactgttggacgatgtgaaatcaaatttcgataggacaccattggtatctgtcagtttcagcacatactgtttgccatcccatttcaattcctgtgtctgactgtcggtactgccagacgcaaaacttggaatggtgttatggctttccatgccagaaatgatctgatgataggctgtagctacgcctccatttgctccatccgcacaaagtccgttataaaatttagcatctgtctgtgtatatggtgcggttgctgttctgcacccggttaccagttcccatacggccatctgtgttgcaagaatcttctcatcttctgtaccagacagactgcccatacttccctgtgccccatacaaaagggcaaggtttacagcatcctgcttttctttttccagactgttccacatctccgacgcatttttttccaaggtgtttccagtatgcagaggaatccccggctcaatacagtaggcattctctccgtctgcataaatccgggttcttgcttcccctgcatgaccgcagacaatcccattatgagaaaacgtctgctgataacgaatggtatttccactgccatcataacaataatcaaaggttataacagctcgttccgatgctgctgacacggttgatgctgggaaaacggacagcgtagtaactgccaccattgccagagcaatcccttttcgaaatgcttgttttatttttttcacttcattctcctccatttctcctgcctttcggctgcataaaaaaagccctgctctttggcagggttgggtactcatccggtggaatgtggatagccaccgactccttttttgttttttcggctggtaaactgctggtaatccagaaggggtagggtgtggggaggggaacccagaaagcaggcaatccacaaaagaatccactttccccttggcgtacccctacctctcccggcttttttcccgtctgcggtacagttccaaagccttgatgatcgtatcctccatctgtttgactgtggttcccggcgaaaaatacttgtccagtctcctttttggaattttgaactgctctacctgattgggtttttcctctgtcataatggacagaatcacttcctcattcagttttcccgcctcggcaaacttccgcagtttgattgcctgtgcatggcttggtgtacagtcctccagttccattgtgtcaaaaagttcctgttgccgttctttcggcaggtaagataattctaccgccggacgcatggcaatctttccctcatccaccagatccagaatcggtggaatcagttctgtaagacggatataacggcggattgtatctttactttctccaacctgttctcccaaaatttctgccgattcttttccttttaacttccgagccagtggcgtggaagttaaatctgtacgctttccctgtcttttcatagcggtcaacttcatcttatatgcaaaggctttctctgacggaagaacttcttctctctgcaagttagaatcaaccatgacaatcgttgcctcatcatcagaaagatttctcacaatacaagggatatcctgcctattggcaagttcactggcaagttttctccggtgtccggctatcatttcataaccgccctccggtttcggacggactaaagcaggattgaggacaccatactccttgacactttctgccagtgcaaccatgctttcgtccatttttactttaaatgggtgattggggaagtcactgatttccgctatcggtatgtcaatcagtgtttctctttttgcctcatcccgttcctcctgtgtactgaacaggtcatcggcagagggaagattcaactttattgcgttgcctttcgccatctcgtaccacctcctttgtaaatgcggcatacgcttttgctacggctccatttttgtcatatcggtaaatactttgccctgcggcacttgtttctgctgcttttacaccaacaggaatcaccgtctgataaactttgatcactttcccataattttgacgaatgctctctgcggtaatccgagcaagatttgtccgcatatctgctaaggtcaaaagcactccatctactttcaaatccgggttaatctgacgctgtactttcccaatggttttcatcagttctgtcatcccctttgccggaagatactgtgcctgcaccggaacaatcacactgtctgccgccgccagtgcgttaatggtcagcatccctaaacttggcatacagtcaatcaacgcataatcataaccattctttacttctttcagataactttttaaagtaagctcccggctcatagcattgaccagtttcatttccattcctgaaagttcaatattcgatggcacaaggtcaacgccttcctcatggtgcaggattccggtgtggctatccattttttgatctgtcacaatttcttccaaatgggttgccagtgtgacaggcagttcatcctgctccgcccaccctaatgaagttgtcaaatccccttgtggatcagcgtcaatcaaaagaactttctttccctctcttgcaagcccgattcctaaattgactgttgtagtcgtctttcctgtaccgcctttctgattggcaatcgcaatcaccttacaatttgacattttgttttccctcctttcccgaaaaatttaatagccatcttcccgtttcgagaaatggctatgtataaaaataggcatgaaaaaagccggatgattttcgtaattgaaaaccttccggctatgtatactattttaatttttgcatataatctaagtaaataaggagatcattatgaaaaataaaatttcttattcaactctatatcaaacactcgatgaactatatgaaaaaataaaaaaggaaggatattctgatctttatttagaagctcttaaagatgcacagaactccctccttgttttagagctactaaatttagctcgttcacctaaagttaattaaatatttcattatacaatggttgaatctctaacggtatttgacttatcgccttatgaattctatctttaatagtttctgcttttacttgtacactcacatatttaccttcaacacttacacatccaggtactaattttactaagagagccaaccattctgatacttccttcgttgaacatttcttctcgattttattgttcaactctcttcttacaacttctactactggtgcttctgtatccgttttttgaagttcataaataacatcaaccaactcataatacggtggtatttcaacctctttcttctcaagattttcaatccattcatgaacctgtttcggagagtagcacgtctcaaataaatcacgtaatttatctaatcctaattgttttggtgtaactaaaagcaataattttattaaatcctttgctgaaaccatagttactttttctctttgcgattcaaaatttattgcactcccatcatcatttgcaccttggtaatctattgctacttcaatacaataatctgcattataattttcctgatgtctttttaatcctgataaatgtgctgtccccgctgaaatacgcgatttcttagtactttttgcatcataagtaagagaatatccttttgattttccattctcatcatatcctaaaaaagcctctgcttttccgtcaggctctccatttcctccaatcggtgttacttcgaaaccaatcgcagctaaaactcttgccaccgcatcttctaatccatctggattatctaatgaatctttcaaatacattgcaacagctggtatacccgctttatctgctaatgccaattgtctcaaagtactatctctcttcttaattattccattaaccatttcctcatccattccgagttcatataaatgagattctgttaaaacttctgtaatcaccatgctttccaacggaatcatattattatttgaatctatataatttgcaacatatggatgtgctttattaatcattaatgtccgatttttgagatttagttttgctataggggcatctacatttttatactcccactcaatattctcaataacctgttcacctgtctctaaatttttttcatataaggacaataattcttctttatcttcttctaacggtttctctattaaaatcggattcactatttgatttgaataaaaattctgtacaaaatcatatattggctttttagacgtaagatatgatgtttgtgccattcttgaagaaactgattttttctcttcaatctgagtctgctgatcaaagtaatattttcttacttcattattaaatttctttttaatatactctttcaattgtgtaaaaggcaaagaatcttttactgcttctcgtgtagatgtcaaattattgtccaactcatctgcattaacaattatacgacacctgttaaatgcaccatgtgaaaaagcttccattcctaataatgcatcttctaggtttatcaaacgccctcttataattagaaatataccatggcttctaccaagttccgctgattttccctccaccaaggaatcttcatataaaataaattccccatgaacattttttagattatcaaaatctacaaaataattttcttcaccattttctctctttactctacattctgcagttttcaacttttctgcagtttcatcatcttttccaataatccatttcttcattattggaacattgatttttgacgattcaattttttcaccattaaagttcaattcaaatccaggattcaatggaagagccgtacttaatatccatttcaatctcccaattttaatttcatttgcttttggtttcaattcagtcatcaacgaaactgtccatgtgagttctgcattttccccaaaaagatcaaattttacaattttttcatctatatattgttctaataaactttttgcatcatcttcatttacttctcgctcgtcaattaacaagctcttataatcctctttaattaaattataatccatcgttgcaagaatatatcgtccattttttttagaaatatatgataattttcttgctaaaatatatgttgctaattttcctataccaaattgtcctatttgcaatctttttttatctctttcgcctccttttcgttttgaagactctccaattttccataaatccttcaattcttgagaatcaagcccttctccattatcacatacacaaatataagcaccttcaactgtaaaatcatatggcacatagactgaaactttacttgcaaatgcatcatacgaattacatactaattcctcaaatgctttgttagggcttgaatacaaacctgctgaaaataattcgattattctatggcttatggtgacttcaatatcatctattttttttccaacagtatctaaatccatatttaaagcctcccactaataataaattcttcatgataaacctttcgcttagtcttatctttggaaaattttcctttttcatctctataaggtatacagattcttttagaaatagttctctttcctatttttatatcccggaacccgttgtcaaacaacgcttccaatagatgttttgaattagggatcttaactcctttatattctgtatcacctacaacaaaaaagaccataccattatctgaaagcatactatggcaccgttcaacagcatcctgcatattgctataatatcttgcaacagatttgattttcgaactcggcattccaatattatcaagggattctacaacagtttttcccgtattattcaacttctgaacatccatcgtaaaatcatcactgttatatatgcttccaattgatccttttcttaattctctataatccgtagcataccctagccacaaagatgataattgatgtaaatccgcatattcataagatgtcacataaggggggcttgtaataatcaaatctgtctttggaagttctctctcttccaaaaagttagtacactttatcattgtttgtgtatcagtaacttcaatctctgttaatgctcttatgaacttgttcatttgtcgatcaaattgttgcattacgtctatctcttttttttctggatcaacctgtggtttaatagattttgttaaccattttgagcttgcttttaatatagatgaaaaaacacactcaaaagcttcccgatactttccttctggtatctcttccctaatagcctgatatactttatacaaattacaatatgttgtctcatagtaccaatatttcaatctctgatttgcccttttgtataaatccaagggtagttcatattttttaatattccctaaaattttctggtaatatcgttcaatctctttgcaatcatagatattactcttagtttttgctatcagcgtcgcaacaggattaatatcacatccccaaaaactatatcctcgcattttagcctctaaagccactgtaccacaaccgcaaaaaatatcagaaactttcttaatctgaactccctccttttcagcataatcaaatgcttttgaggctataaatgctggaaattttgccggatatgaatgtatggtatgcattatcagttcatttccttcacaatcattccattcttccgatgtatttattctatcatagtccagttctccgatattatttatctgtaccatatcttttaccctcttccaaatcattaaaatcaatattattatcttcgcaaaatttggagaacaagataatagccatctcccgtggtactgttttattattttcccatctgtttattgtcgcaaagctaacatgtaattcttgtgccaacctttcttggctatatccgagttttattcttacaaaacgtattttttccgaaaatttcatattactacctcacgaaaattattataacaaatgctataacatttctcaacttaagaataaaatatcaatatcagcgtctgtagatactatcagacaggttatcaaacaaaaatcggcagatgtatctaacattcttataccgattcaattgttttatttcgtatttaattttaatttatcatacaagtatcaattgattatcctcactttgctgctcccattacaaatttttcctgtaaaaagtcacaaaatcattttgtccacctagtattatccagtccatttgatgctatcttattcacaaaatatggactaaacaacataaaaaaccaccagatattcctcatattccgttctcaacagactaggagacaaaatactctactgcattgttcgggaagaattccttgaactctccatatagctgcgccgccagagtcttattatgcgcaatgatcaacgttggtttattcaattgttgtataacgttcgccatcgtaaacgtcttacccgaaccggtaacaccaagcaaagtctcgcattggttgccttccttgaagccttttactaaggcttggatagcctggggctggtcgccggttggggagtattctgatactaaattaaaatggtccatggttttctcctttaggaatctgtctaatctattttcttcatcttaattcgtaatattcttcttttgatattatagcagaagataaaaacaaagtacagaataaatcgaatgtttgttctgtactttgttttgttaatttcattctacatatttacaacaagtttttcgaattcctcttccgtatcaacaaaatgatatggttcatattctccataagctgagggtctgctgatcgtgacaagttgaattttttatatccaacttgttcctctattgatctttttaactccgaaaaatgtttcccatgtgttgtttttaatgcaacacttccaacttcatctatatgtttagccactaaataacacatattctaacgcctccttaaaaattgctacttgtagcaacttttttatttcactgttccaacacacaactaatacataaatggtttttatctaatatttaactatttctctcatgtattcctacaagacaatttagtaactttaaaaccaacaactttcttacataacattttcttaattcttctcttgtaggaatatggtattttttgatatactggtacggttccataccacattgctccaaacctgaactatcataaaatagccttattttaaaaatctctcctgccttataaatcttctttttatcaataatttcaaatttacaaaaatcaccataataattcttccgtaactttatttgagggcatactttgtcctctttcaaaaaatcataatctatatgtacaatgtcgaacatatctttcaaaattcccttggtttcatatatatgtgattcattgaatacatctcttggtggtacaacatatcgtttcagatcaaacatcggaaaaactcgatacgtatggtctttatgataacttaaactcaacttaaaattatctccatactttaaatgaacctcattactttttactttaaattgacaatttttcatataaccataatcatcatggacattcacaactacctgtactttttcatctttctgccctatgtatctaatgtttatatgttcaaacatgtctacatatttattcattccatctttgcatggaaaagatctctgattctttaaatcccaaaaccaataatccgtattctcataacccagtaattttctgcctaataaagttctatttttaaagatatcattttcatctcgttcaggccaatatacccccaaagctcctgaattcatatgctgataaactttaagcatttgtggagcaccacctatggtagaatacttattctttttctcctcattcagcaaatcacacattgcatcaaaaggttccatatcaaatttttcttcaaatactttttcataattttcgccatatttttcctttaatattgtttttaatttttgaacaaattcttctctcttatctccaataatggctatttgcccaaaatgattttcaaaattttcaaaattaatcttcccattttgaactacttttgtttcttgagttcttttacttgttttaaatttatagtgataatccgtaattccataaaaaatctcttgactataattactatagtttactaataacgaatcttgtcttttcttatccgcttctttcaaaatgctcttgtaattattcacaacacaggaaattgttttaaccacaaatatttttcttaaccaatcatagccagcaaaaatatattcattcatatatgggctgattatattttcgtaatccgatgactgcacataatttttaattcgtgatgtcatatcattcatgagacgcacaacatgccccgccaaatcgtcaaaactcattgctccactttgtgcttttaagtattcatttattgcattattagtttgtaacattaaaggatatgaataagcagtatcaccagcgaatcccagaatgcaatcctccctttcaaatttcattagtttcggacattcatcccaatatactccaccattcaatctactatctgaaatcattaccacttcatatatatctttttttctgtttacttttctcacccaagaagctactacagtcatttcattccccctaattctctttacacaggaagctcaccaaacagcactaaataacaatctaaaagctctattttactagaataaaaaatgctccacggcattatccgagaaaattctttaatcccctataaagctatgctaccatagtctcattatgtaaacaattaacatcttacccaaaccggtgatagcatctaccttgagtcttctatactctttcataatatataattgaaattccagagatattcaagtaacaaaggatattgcaatatcactgtgtgtaagtcccccctaccttctagactttgaaacaattccactgtccagaccattcacatgaatacatgtattctgtgaactctctataccgcgcttataatatagtttcctctaccaacttatcaaaatcacttttataattttgatcctgtattgctctatacttttcaaattcactttcagcaaaggctttcgcaatttctgctgtaaccttccctttcccttgcaaaatcgtttcctcatttagttccaaaaaaacatccaattttctcgcccaatcctccattgtcatgggaatatgttttttcgcctgtctttccgcataatctaaatacattgaaacaaattgatttaaatcttttatttccaacatagataaataattctttgcaatgcttacatcagccttcacaatcttaccatctggtgcatttttccatgtctgtaaacccatattctcttttctgtgatcagctctttctacaatcacctctgctgctgtatgtccatgaattgcaaaatgaagcttattttgcacagtagcaaaaaactctttcgttgtttttgcatctttcgaataatctactgccgttacatagatatctgttattttttgataaaacttccgttcgctagcacggatttctctaatctcatctaataaatgttcgaaatactcttcatcaaaaatctgtccattttctaagcgctttttatctaagacatacccctgaatagtgtatgtacgtaatacttttgttgcccattgacgaaattgcgttgctctcaatgaattaacacgatagccaaccgatataatagcatctaaattataaaattttatattatatcttttcccgtcagttccagtatgtcggtatttccgacatactgaattttcttctaattcaccttcttcaaaaatatgtttcaaatgctctgtaattgtagttctacctttatcaaaaagttgagatatcccttcttgagtaagccatacagattcatcttgtaccctcacttctattccatcttcagaattttgttttgtaaaaacaagaaaatcaacggtactattacgaatttgaattttctctttttctcccataaactcgctcctttgtatcatctatttaactttttctattattcatttgcttcttccgcattttcaaaaggacgattctgcatacctataatttcaggatgtccaaaatgcaaattacttataaaatataccatccatcgtcctccttttttattacgaatttttaccgccaaaagtcacaaaccgcatttcgtccgtctagtaccgttttgtccgtttagtgttatttagtccgcaaaatccgtatttcccggtactaaacagcactaaataacactcattttaaggtcaaccgcgttctcaagaaagaactccttgaactccccatagagctgcgccgccagagttttgttatgggttatgataaggatcggcttctgaattttctgaataacatttgtcatagtaaatgtcttgccagagcctgtaactcctagtaaagtctggcattgattgccttctttgaaacctttgacaagggcttcgatagcctgcggctgatcaccagtaggctgattttcagcttggaatttgaactccattgtatattttacctccttgataacctgtataaaatctcaaattgttaaaaaatttaatattttataatttctttccctttgtattcgcacggattgattataacataaaatgactcaaatcattcctgttttcattattctcctctcataatataatcatgagttaatctattcattttaagtaatttttatatgaaactcctgatcttaacttaccagaaaaacttcatattctttctctacctttttcatagccatgtcatgagaaatttttccctttccatcaagtacgtctcttcggttatttttcaaaaactggttcatttattctacccaatcttgcatactcattaaaatctcatcttcagaattccgctgcggtttttccggtaactacaaaatgaagtttattttgaacaaatgcataaaaattctttttgatttcactatttttatcataatcaaatctacactgctcgaacacatctgtgattttctgataggctctacgttcactggcccttatttcacgaatacgttccagtaattcatcaaaatagtcttttccaaatggcttcccattttttagcaaatcatcattgagtacaaaacctttcgtaatatattcctttcatgttttcgtagcccactgacgaaatcgagtagccttcttagaattaacacggtagccaacagcaataatatatcctctatttggtataaaacaatttcatgttctttcgtcataatttttacccctctgaaatcactacacatgtattttgtatctcttttatttactactgaagtataatttcatatcaaacccctgattcagtccttgtctataatcggaaaatggtgttccacaaattaatccttgaacaatcacattctaaaccactataaaactcattatctctacctatatccgcctgtaatattctttctaaaacaaatacagcgttcaagaacgtatgttcttttcattttatcagaactaccatctaaatacaaccggataatggacaaaaagaaaaaacaaattagtaatgcttttgctgctatgaagcctataagctgaatagcaacctaaattgaaaagaatccgccaaattatctatatctttcacaataaacatgatatactttaaaaacaaaaaataaacagatactattcataaagtatgctgataatccaaatcacccccatatggaaatctaagcagcctgatacaacatttctcacaaaggacaaaataaaaaagcagagggagattactatgtcaaaggaaaatacaatatgtttaatgaacgattcttttcctccactgatcgatggagttgccaacgcggtgaccaattatgcagctttttaccagaaaaacttcggacgtgcctatgtagcggttccataccatcctgatgctgaggatgagaagtttccattcccggtcatccgttaccggagctttgatacaacagagctgttgaattaccgggcaggctatccgttctctgtcagcgcaatgaaggacttaaaagaggtaaactgtgatctgatccacagccactgtccatttatgtccactgttttggcacgtatcctgcgcagacatgttgacgttccgcttgtatttacttaccacacaaaatttgatatagacattgccaaaacgatcaagtccggcatcctgcagaagcaggcagtaagcctgatcgtagataatatcaatgcctgtgatgaagtgtggacagtcagtgaaggggccggagaaaaccttcgttcccttggatataaaggtgattacattgtaatgcagaatggcgttgatattccaaaaggccgtgtatcacaggaggatatacaaaaagcagccaaaggagcagatctaccggagggtgtacctgtttatctctttgttggaagaatgatgtggtacaaaggcctgaaaattgtatttgacggactgcgcagattaaaagaagatcacaaaccatttcgtctggtcctgatcggaaaaggaaaagacaaagaagaaatggaaaagtatacggaagaagcagggatcagggaccaatgcatctttacaggggcaatctatgacagggatgttcttcgtgcctggtactgcagggcagatctgtttctgtttccttccagctatgatacaaatggccttgtggttcgtgaggcggcagcctgcggactggcaagcgcacttataaaagacagttgtgcggcagaggggatcatggatggtgtgaatggattcctatgtgaagagaatgctgaaggcatgtattctctgctaaagcgtacacaggagcacccggaagtgatggcacaggtaggacagcatgccatggacacgctttacctatcctgggaggacagcgtagcaagggcggcacagcgctatgagatagtcaaagagaaatatgcccgtaaagaatatgtcagccagaagcgcttctccgacgaggtgattactgttacaggaaacgccatggatggaattgagaccctgcggaatttacagcagtcgtccctggaaagtatagagaacctgaaaagcttttcaaacattccaaaagaggggatagagacactgaagaatcttcagaaatcatccatggagaaacttgcggcaatgaacgagtggcagaaaacatatctggaaaagcttgcagaaaatcttaggaaatagtattaaaatgtaccgttccctgccaattcccctcaaattccacccacaggggatgtataaattgctccaagaatggtattctgtgtttatgaaatacagaggaggccgacaaaatggatcaattggaaatcggaatgtttattgcaaagaagagaaaggaaaagaatttcacccaggcacatcttgctgagaagctgggtatttccaataagagcatttcaaaatgggaaacaggaaaatgtatgcctgactatggcatcatccagtctttatgtaaggaactggatatcacaatatctgaattgatggacggcgaggaaacagaacctgacagtatacgtgtttatgacgatgaccagattttagacttgatcaaaagaatacaaaatctggaaaaccagaaagtatctctgtacggtattattctcatgaccatgggaatcgctctatttgcagtccacttctctatcggcggaagcgatgtcagagatttcttttcgggaatcctaatgggtctctccatcgtagaaatgctcattggtattttcgtgacagcaatgggcttttccaggcaaaaatagaaatatcatttctcttatcagtgctccattttgtcagaacatacacttctgaccgaatggagcacaaaaatcatattgtctttgttccatatcctgtgggattttcctcccctgcatatctccggtccagatctcttctgatttcaggaaattcaacatccagcttgtaaaaccgcagaacaaacgccagcaccccgcacacagccaggggaatcaaaataaatccgaacaccatgaacgaattccggccagacatctgtgcagcagtcccagccggacttcccagatttgccgcaaagactgtcaggctctgccttaccacacctgcaaaaccagcccctgctgctatggccgcagagataaccgtcaggggaaataccgcgcgcgcccttcctgtgaaatgatctacatggtcaaacacatccggttccatagcccaaagcattgcccacagaaatccgtttccaagctctgccactataagggcaaggtaatagacaggcaatacttttatactgatgagcataagaagacaggccccggcatagactgccgtgcccagcactgcgcactgtctttttgtcattttaccggccagaaacggtacagccaggtatgctgccaaaggcaccccatatgtgataacctttacaagagcagcattttctggttcgcctaatatccagtgtgtatgccccccgctaagggttgaaaagacagaggtgccgaacatcaggataccaccataaagcagcagcagccaaaaatacctgtctttaaaaaaagctttcaaatcctccccgtattcttttagactcattctctgtccgtccggtacagggggaagatatgtctctttcaaaaaagcactacccagcagcatagaaatcaagatcactgctgtaaataccatcacatattttctgcccccgtcggtcccatgtacccccggcgctgtgagaccgcccgccatccagccggcacagatcacagccaatcctccggcaaaacctttcacagatgccagattcgtccgctctgccgcattttgggccattccggcaagcagtgcatccgcaggacaaagcagtaatctcacgccaaaacaccatacaaaaaatacaattcccacatatactatttcaatctttgcagcagcatgcggcacatatacgctcatcagtgtgctcacagccactaaaatgatcccggtgtatatccaggatttactgcgtcctgattttttacgggttctgtctatgaccgggcttataaaaaatgctgccaataaagccgccgccagaccgcttatcattatgacacgcgccgcatacccggaaatgtccgtgtcctccatcatataggacatcatgccggctgcagtaagtaacggcagcatcttactgccgaactccacagctccaaagcttaccctctgtttccagataaaagcctttgcatctgctgacatatttcccataaaatctcctcccccctcttcttccgttctcctgttttactgattcctccttataaatcacgccgccgagaaagtggtgacagaatcttactgccacaaagtcatgccctcttcaaattttaatccacgccttaatatcggttaatacttattactattatacaattttcagttaagttccacaacaaaaaacacatccggcatttgctctcttcctgcacaaaaagcccggatatgagaaattggacagccccctgtcaaatagacaaagggctgtccaaattttcatgtccggacttcttgttcttctatccacgctcctgtatagtctgtgattcccttcccggtattgggatgcagactggaataaacctggtcagtcccaaataccgccagcagagatatacacacaggaatcagtatcttatacggcattttcctgatcagatcgtccagaagaggggctgccacatagacaatagccatgcctcccaggccaaacaccaacaacccttccgcgcagatccttccattcagattcaggaaatagccgctgtagtcccaccacttctttccgttatgggtaatttccaggaaccaggaggtaaagtattccacacagccgcacaacactatggtcagaaggaattccacaacgggctttcccctgaatttgttcaggaccgccaggatcatcacgcctcctgtcccgtaaatgggcagccagggaccatgcagtacaccccggtttacgaacacaccgtctgtgataagatgtaggctcacctcccatatccatcccataaaggaaaatgcaaaaaatagcatgataagcgaccacacagaataacggcgtatgtaacgaagagtctccgccctctgtcgcttcctggtctcctgaatgggaaacagccttcccggatatgccttcccctgcactgcatcccggatcacctggtatttgagctgcccctcctggtattcctcatagatccgctcatcccgcctgttgatcactgtgattccaaacacattggcaagcagccccgcaaaaccggtcaatcgctccggttcctccttttcttcccccagaagtgtggcaagtgtatccccatatacctcgaagatcacatcgtcatcggccttctcaaataaatatctgtcattcagatattcgtacccttctattttcttttctattgccagatttctcagatgggcataatattcactgaacgccgccaccttgtagggattggaataaaaaatcgcggtcagccccagggtgaggctgccaagcatatcccatccccaataagtaagttcaaagacaaagcattcccacttatgtccgtgcatgatctttctggaaagggtaatggctttcctcggagaaatatcaggattttctgccgcgatatagggtaccagaaaataggagtaccgcttgatgatcccgcctgccaccgtcaatgcccataacatctgatacagggctgtcaaagccatagtcagggacacctttatccatctctttaccctaataagaaaagtaaagcgctgaatagacaatttctcatacacacggccttccagaaaaatcctccgggaaactaccgtatacatgttaaacaaaaacacccaggccgccagactcatcaataaactgagcaggataaagataaaaaccgttgctccggcagaccccaccatagaattcactgccgcgatcagagtggccaaaatggagccggaggagatatcattcacaaatcccgccagcactcccctgctcctgcccaggactgcattgcctttcccttcttttgtatcctccacttcctgttctttcaattcatttgataattccctgctctccttctcgtttccctggagtgcttccaataccacatccgaaagattgggctgacctcccacaataccgtttacagtggtgttatgggtctgtttctctctggattcaatcctgattccattgagggaaccggaaaattcacttcccaacatggccgccactgcacagactatcacaaatatcagataatgcttccgcagagactgtcttgctttctgcttcatctcttttcttgtcaacacatactcatcctccgccttctgtctctgttctaccgccagattttaaaaattatatatttcacccggcagatcagttttattttatcactggttttatctgcctgcaacccggtgcataaaagaatgtgcggtttgtatccggttcaatcccctctgccaatccactctgagagagttttgcagagctgtacaatatccagtggtttgctgacatgggcattcatcccggaggccagcgcagcggagacatcatcgctgaacgcattggctgtagtggcaatgatggggatactcatggccatggggtgaccggaggcgcgtatcttcttggcagcttcgtacccatccatgaccggcatctgtatatccatcaggatagcgtcataatcaccgggctttgagactaaaaatgtatccagtgcctgctgcccatcctccacacagtctacctcagctccgttcatacgcagcagcgttgccgccacctcctgattgagcgcattatcctctgccatcagcagccgaaagccgtccaaaggccggccggaagcttcccgctccccagaggatgcagtatgccggcctctgtgttccagtatctccttgatggcagaatagacagaggaacggtaaagcggctttggcagaaatccgttgacccctgcctcccgtgcctctttttccacctctgcaatgtcataagccgagatcatgacaataggaacatcatttcccacctcacgacggatgcggcgtgtcacctcaataccgtccatgcccggcattttccagtcaataagacacagatccatgtcctgaccttctcgatgcatccccttcacccgttttacagcctcggcacctgacagacaccactcagagctgatctttattttttctaagagaacagcagtctgttcacaaacctgttgttcatcatccacgatcaatgcccgcagcccctgctgttcaaaatcaggcttcaaaacgccgtcctcctgccctattctgaacggcagatccacaatacaggtagttcccgctcccggctcactctctatctggatctgaccgcccatcagcgtaaccagatttctggtgatagacatgccaagtcctgtaccgccaaagcgttttgcaatggaagcgtcagcctgctcaaaaggctggtatatacgctggacagcctcctttgacataccgatccccgtgtcagagagaatgaagcgcagtatgtaagtggtattttttttgccatgcagagaaacctccagacggatcctgccgccaggcggggtaaacttcactgcattggaactgagatttaacagtatctggttgagtctcagtgaatcaccaataaatatggtattgcctccaaatccctccatagtttcatcaaaagcaatccctttttcctttgcctgtgcataaacagtggctgcaaacccgctgacgatctcgaaaatgtcaaaaggctcattctgcagtatcattttactgctctcaatcttagacatatccagcacgtcattgatgagcattagtagatgtttggatgaaaaagtgattttagagagacattcttccactctggcaggctcccggacagaagccgccgctatggtggtcatgccgataatggcgttcaggggtgtacggatctcatggctcattctggataaaaactcgctttttgccagattcgcccgctctgccgtcaacattgcctcctgcaggacctggcgtgatcggacttcttccgtacggtcggaaaatactgtgatgagctgcggggttttcaaatcatccacccggtagacacggatcagcatccagtatttttctttatttgactttgtatactccaccagtctttcatatggggcatcggacttaagagagctggcgccctcccggaccgcctgtgcgtccacctcattgagaccctggtagaagctttccgggcttgccatggggattccaagcacccgttccagattcagtccgcggtagctgatatcccctgtgttggcatcccggataatgaatgcatcgtcaatgctcagtgacagatcatcaaaaagtctactgcggtaaaccagttctttcctctggcgctgaagaacatactgggagatcagcagcacccccaccatcaaaatcatgagcacaatagaaccgatcagattggtgagccgcagccgttcggctgtgatcccataccccaccttttttttcctgagcagtcaatataacgctttccgtctggcgaagggcagtgtcatagacaggctgcagatgttcctgggcataagcctctatcttttcctctgtgatatccggctgtcggcaaaattccagatattttgtctgctctgtgcgcagaagctccagaatacttttgagtatctgtacatcctccctgctgcccagatacaattcctccagccgggcaaccggtttctccagagaatgagacagttcctccagcttattttgggcaaattctatatcgtcactgctataatggcgttccagccgtcctgtccgcagactcatctctgacacataaagcttcacatctccggcggagatcaccacctcaaaaggatggtttgatatgatttccgtctgcgccgccagactggcagaattcctgacgttcatgaccagataaaagagcatcagaagaatgagtaccaccgtactgataatacttatctgctgactccgtcctatgggaatcatcctcttttttaaagttctttgcatctcccttaactccttgcctttccggctctgcacgctcctccccggatgcctgctgccaatcatttctattttttctgattgttcacataccaatttattattaagtatagcaaagataaatagagatagcaactgccggtcaaaactatatctgtctgtttcttaattatctataaatatgcataaaaagaaaaccgactgctgatcggtttcttcacattccggatattttacctctaaacacagggcttgggaatccatatggtttccgtccccggaataccaagctttgacataaaacccgctgtttttcggaactcatagatcatgagcgcctccagttcctcagagaacctgagaaaatctgttttttccagagcttctataaagacatccatataaggaccgtagacggcgttgacagtatcctggctaccgatcatgccgtgaaatgcatttgcccagaaaaactgctgctgcagctcagaataaacggaccggatcgtctgaaacggggcatattttacgattatatccatcatttgaaaggacagggtttcaccgcgctttctctccttctggatcttcagttttctacggataagttcaatggcatgggcatcaagagaggaaagtgtgagcacacacgtctctctgcaggacaacgccaggatctgaaagctctccgtcatatccacaagtctccggcggaaaacagggttggtgaaatcgctgttttccgtagccttttcaagaggaaggacacgtgttcccacatatttcgcggactttaccgccccaacacagccaagaagaccaagcgccctgcgggccgtacttaccgaaacacctctctgccctgcaagctctttctgggatggaagcaggctcccttccggataggttcccatgctgatcgacaggagaagttccatggcaaaagaataacacaactgctggctttttttatagacactccagacaaaagcagactccttctccggggaatgcatggtgatctttgacgcatagaatccttcaagagccgaagacagtcttttcatgggttcatccaatgtacagcgcagcccagcccagtcttttttacggcagtgattcagaactgtgggcagatgatccgcagactgctcaaaatactgtttgctttccctgacactgaaaaaaggatcgtgcagaaacataaaggtttgccatacaagacgcatgagaagccgattcccaagcgcgctgtacttcagctcaaggttatccagcattgcgtagggagcatggtcattcccctgacgataaagccgttcaatggcctgcagggtctctgaagatgcatttttcagccctgtccactgggcattgccaaataggggctgcagggatcttcccaggtccatcattgcctgcctgcgcggagaaaaaaaagcctggatataggcttctctctcccgggcgtcatagtttacctttactgctgcacctgcttttttcgacagggtgatatatccctcctccttaagtctcaggtatgcggcacgggtggtatccaccgatacgtgaagacatgcactggcctcctccatggtgggcagtttttcaccgaaaccatagacaccaaattgtattttactaagcaggacgttatatacgatattgcataattctgtactgtttttcaataaatctctccattttgatccaaaataaaatatattgcaaatccagtataccattttttgtgccgaaattctaccgccgtttccggccttgacccacgtctttctcttttctctaaatgctaaaacagccggggaccaaaactccccggctgttttctataaactcttattcctttatttccaaatgtatgatactgcacgccggaatgtggaactgaagtcccttttctcccaccttcgcactgtcaaaggggattgtcttaacctgatccggatggtcaaatgtattcccatcccttatgtctccggtcaatatttctccctctgcttcctttatctgccttccgcttacttctgcctcgatatcatacccttcatcagcggataaattggtgaccgtgatatgcaaagtgccgtttttgtcaacggaaacagactgcgttaagttcggcaccatgtactgttcctgcaggccgatctgttttgtctctatactgctctccaccagagttgcgtcctgatggcatttatacatatgaaagacgtaataggtaggtgtcttgaccagcttatccccttctgtgagcaatacggattggagcacattgactgtctgggccagatttgccattttcacccggtcacaatgctgattaaatatgttgagatttattcctgcaacaagggcatcacgcatggtactctgctgatacagaaatcccggattggtaccaggctcgcagtcaaaccaggtaccccattcgtctatgatcatactgatatttttatccggatcatactcatccatgatcgccccatgaccttggatcagctcttccatgaacagggttttatttaaagtccgataccagtccttttcatcgaattcagtggcgcttccttttactttccagtcattgggaactgtataataatgtaaggacagtccatccatgaatccatgctgttccggctggctgtggcggaagcaggcagctaacacttctcttgtccagtcgaaatcctcagcgtttggtccgcagcagattttactgatcttcctgtcatttttgtagtctctgacataggtctgataacggcggtactcattggcataatattctgcagtcatgtttccgccgcagccccagttttcattgcctacgccccaataatcaatattccatgactcttttgatccgttttcaccgcgaagctgtgacatgggggacattccctcaaaggtaatgtattccacccagtctgacatttcctttatcgttccgcttcccaggtttccattgacataggttttgcatcccaactggcggcaaagctcaaagtattcatgggtaccgaagctgttatcctcaataaccccgccccagtgtgtgttgacgatctttttccgtttctcctttggtccgatcccatccatccaatgatattcatcggcaaaacagccgcccggccatctcaggaccggcagtcggatctccttcagggcatccaccacatcttttctcattccgtttacattctcaatgggggaattttcccccacataaatgccgccgtaaatacatctgcccagatgctccgaaaaatgtccgtagatctctctgtttatctttccttttattttgtctgcatgaatctgcattttatacatatctcagccctcttattccctatttgtacaattcagctcatccagcaccttcacttggaaatcccggaattccccgcatccgttctccgcgaacattccgatatatgtacctgtaaatgtcatgcattttgtactctcggtgcaaagtcctaccaccagtccggtgccaagctctgtaaaatgctctccgtctgtgctgaaagaaaatctgtataaggtcttgtcggaaatgatccgcagagtaacattctctgctgtgggaatttccatacttgccgtagtagtaaagatatcgtgtacatgttttgccaggcacaccttccatgtatccagctctcttgtcagataaatctcatagtgatatgagtcattataatatgctgtcaggccggcacgcatgccctgcactggttctttgactcccacgtttactgtggatgccgtctcaaaacctttctgacgtacaccgatccaggtggggcttgccatctcatttatggtggtcttagttcctgtcagggtcatggtttttcttccggtatcccgcacataattttccatgtgaggatttctgaggaaattatagtggtgactgaagtccttttgtgaaaaatcatccgcgaagtcacggtttaccaaagccggtttctcacccggaagaggagcgtccatctccagggagatcagaccgttctcccctaccaccggccagccgtcctcggtccagatcaccggtgccaggaaagtctcacgtcccagattatgaagcagtaccctgctgctcttctcctggcacgggcggactgcaagacagaccatccaccagtttccgttatggtcctccatcatatctgcatgtcctgtacagtaaatctcctccctcatgtcatctctatgggtaagtatgggattatggggacacgcttcaaaaggtccgtagggattgtcggaacgcaggattgtttccatatgtccgtattctgtaccgccctcggcaagcatgagataatatctgccaaaccatttatacagatgagggccttccgcgtatctgcctccgcatcccctgctgatcacaatactctctgtcaagcgctcccctgtaaaaggatcgacctggcactgaaagattcctgtatttccctcttcatcgatactggtagaggtaaaatatacagttccgtcatcgtcgaacaataaggacggatcaattcctccctggtctacccatgccggttctgaccatcccttttccagatcagtggtatgtacaataaaatttccttttcctgatgtgttggtggtagtcataaaaaatgttccgttgtgataacgaagcgtcggcgcgtagattccgcctgagggtttgcagccatgaagactcagctgtgattctctctcaaggcagtatcctttcagctcccagtttacaagattcctgctgtgatagacaggtacacccggaaagaactcaaatgatgaattgacgatatagtagtcttctcccacacggcagatagacgggtccggattatacccggaaataacaggatttttgtatttcataaaattgtcctccattttgtcgtattaattgtctgtatttttgtcagcctttcagccctgacattttgataccctgtataaaatatttctggcaggtggcaaatatcaccagtaccggaagcagggagaccagggccatggacatcatctgccccacctggacatttccctgggaacccttgaagaactgcaggccaatagcgatggtaaacttgtcattggaattcagatagatcaagggattaaaaaagtcgttccagttatagaccagagccatgaccagtacagccagcataaccggctttactgcgggaaggagtatcctggtaaatacctgcagagaatttgccccgtcaatctttgcagcctcatccagctcttttggcagagtccggaaaaactggataaacaggaaaatattaaatgccccgcctccaagccagctcggtatgatcagcggccatatggtgtccaccatgcccagcttatagtagagtaaatactgggggatcagcgtcacctgtgtgggcagcatcatggttcccagcaggaccatgaacagcagcttggaacaccgggactgaaacctggcaaaaccgtatgcaaccactgaggaggagagcacagtcccgactgtggccagaaacgtgatgactgctgtgttcttgaagtagagctggaaattggctcctttccatccctccacaaagttttcaaccgtgccgttctccggaaacagcgtaggcggcattttataaatatccgacatgggtttaaaagatgtggatatcatccagataaacggaaacagacagatgacagcagcagcgatcaatacgaaatacgtcacgatccttgccgcaagctttgcctttttttgtgatctcgtgtgcatagtctcttcctcctctttagtcatcgtagaatacccagtattttgatgttgatactaccacaatggtgatcagcatgataaccgcaaacatactccaggccatcatagaagcataacccatctttccatacaggaatccattgttatacaggtgcattgcggctgtgtatgtactgttgagcggtccgccatttgtcaggataaggggctgctggaacacctggaaggctgcgatgactgtaacaatgagattaaaatatatggtcggcgtacataacggcaatgtgatatacagagtctgacggatggaaccagcgccgtcgatctccgcactctcataataggaccgtgggatatcctggatcccagccagcatgatgataatattatttccaatggtccacagtgacaaaatgacaatggatatcatggccacatgtttatcccccagccagtttggcccttttaaacccacaagggacaggatatagttgatgatcccatagtccttttggaagatccatccccataagatcgtcacggccacaccggaggttatatatggtatataaaacgcagtgcggaaaaaaccaagtcctttgatcttcttgctgagcagcagcgcaataaaaaatgccagtatgatactgcatggaacaaacatcacaacatattttaacgtattcaggaatgcttttctgaataacgggtcatccgtaaatgcatatttccaattctcaagtccgacaaaattcgcgattcctgaaagattcatatctgtaaacatcagataaaatgaatacaggatcggataaagcgtaagtacgagaaatcctatcagccagggtgctgtgtacagataaaaattcctggcctctcttcttttcatagtcgaatatttcttttgctttcctggtttattcaaactttccatgcctcccattcattcctttcccaatacaggccgggcagtctatcccggcctgtatcaccagctctgtcagaaagctctctttttaattaccgtttgcttcattaaacgctttttccaaagcgggataatactcttccattgcctcatctgcagacttgccgtcaatggtcactgactgccagatctgagtatacacatcacctgctgctgaaaaagctccgccccagatattgagttttgcaccggctaagccgtcaagaaacgcactgttcttaattggtccgtactctaaatccttatagtaagtctcagcaatgtttttacaggaagtcaggccgatcttgcttgtctcttttgccatatcctcattttcatatgctgcctcttttaagaatgtccaggctgcgtctttattttttgatgtttttaacatggcataaccggtggcatacataagattatttttgccgttttccactttaggcataggcactgcgtcccaggcaaaattatcacctacttcttccgcaataagttttgtctcaaaaccgccaagggtatacatagctgcgtgtccggatacaaaaagctgttctttcggaaggctcttggcagccgtgtcatcaggcatggctttgctctgtaccagatctccgaaaaggttcaggccgtcttttactgcctggctgttcacttcacaagtctttaaatcatcagaataagcgcttccgcccttacagatcacagataagccggcatcgatccaatggtttaccatgccgtatgtggcatctgctccctctccgcctacaaactttttggctgcctcagccagatcatcccaggtccagtcagcagtaggatactccacaccaaactggtcgaacatatccttgttgtaagccagtacaaatacattttccagaagaggcattgcctccagctttccgtccgggcgatagtacggctcgatcatgccctctgtaacaacagaatttaaatccaccccttctttttccacatacgggttcaggtcctcatagtattctgtatataagccatagtaatccggggacatttgaataacgtccggtcctgtaccggcggacagggctgctgtcattttctggtcccatacatggtcggctgtggggatcacagaatgctcgatctcgatctccggatgtgctttctggaatgcctccaccatagtctctcttgattttttctcttcatctgctccccatgaccagatgaccagtttttctttttcctttccgtctgctgtcttgtttcctgtctctttagaatttcctccgcaggccataagacttgccgacatcatacctatcagtgtaactgccatcaattttctgaatttcatttttttcctccttgtatttggcttgattaaaatttatgtatataacaaagcagcgcgctatgccttgctatacgttcctgttttttacagtctccccctccaaaatatcaaagggcgaataattcatatatttatatttattcccttccagcatgtcaattaagacgtctacgcattcagcgccctgccgttccggataaattgctattgtggtaagctttggttcatatctctccctggtaaacaggccgtctattcccatgatggaaacatcctccggaacttttattcccagctttttgaactcctccaacatgccaaaggccatatcgtcgttaaagcataggatggctgtggacttattcgctgagtccttgtataaccttgcggcctttctgcccagattgaagaggtccagataaataaatccttccgcttcacaactgaaatcctgtttgctgtcattcttgggcgattctgttctctgcagatccccctggatatccaatatgtattttttgtattctttgccaatctcctgcgccattctctctttccaatacttgtacctgagattcgcgtacccctcattaaaaggcagagccataccgattttatggtgtccatttttcataaggtaatctatcgctgtattgaccaccttcctgttgtctatgatgactgcaggcatgggttttgcatataccgcggacggatcaaagcaagctgtgactgtgggaaggtaataatttttcccaatgctctccgaataggcctgagccactgtctctgtgggaaagaggatgccgtccgccagcgttgtcttcaccatttcaaaatcccgttcattcatgatagccagcacatggtaacctttttcttcggcttttctggccataccatgaaacatctgattataataaacacctgttaaatctccgcagaagaacaaaagctgacgggtcttcttttgctgcagtgccattgccacgggattgggcatgtacccttcccggttggcaatttcgatgattttcttctttttttctttatccacatatccactgttattaagtgctctcgagaccacagatacggaaacgccggcctccagggcaatatcttttctggtaatatttttttccatgatttactctcttcattcttgtgtaatatgcactatttgtatagtgactatactatattaaaacattatagttttcaatacgcagaaatatggtcacgtgtccacatcgtcatattgtctcaaaacatctatataattctgaaaaactgaaaattcgagaaaaatatgacctgaaacaacagaagccggcgtctgcctgacaacatcacagcagaccaccggccctaaaaaatgcagcagcatggcctgccttgaccatgctgctgcaaacacaatgtgacaatctctcatctatcaccgtattataatataagctgtatatcctccatagagcgctaagagcagtaccgcttctcctctgctgatcttctctccctttttcgccaggacaaagagaatgatgctcatcacaagcagcatagccccgtcatagatggactccctgctgatcgtcatgggtgaaatggcggcggacgctccaatgatcagtaggatattgaatatatttgaccctataacattgcccatagccaggtcattctccccttttgtggaagccaccacagaggtgacaagctccggcagggaagtacccactgccacaatggtcagtccgatcagggtctggctcatgccaaaggcagccgcaatgtcacttgcgctgtctaccaccagttccccgcctatgattatcatggcaatacccaggaccgcatatacaatactcctgacaggagaaagcttcctgccgatattctcctcctccggccttacggtgcgggtcttcagtgctgatcttatctgcatatacagaaatcccgcgaacagcagaagcaggatcagcccttccagacgcccgatctgcagtacacccttccctcctccgatggagaacatacaaaataaaagcaagagtcctgtgaccagaatagaaaaaggcatctcctttttcagcagtcctccctgtattttcatgggcaggaccacgccgcacacaccgatcactgccagactgttgaacagattggaaccgatgacattgctgatggcaatatcattattgcctgacagggaggccatgatactcactgaggcctccggcgcactggtgccgaaggccacaatggtcaggccgatgataatggatggaacccgcagggtcttggcaatagaagaacatccgtccacaaagagatccgctccctttaccagaaagacaaatcccagcagaagccagagatacatcatattattttcctcttttctcatgttgtaaaattgcggctgcggttcacaaaactgtaattttgcagggactgtgaacggccgcaaattctgtcaaaattttccgtcaatatctataatatgatggatataccatacagtcaagataaagtgtgtgcttgaaatccattcctgataacgacagattacaaacacccgttaaagaaggggatgttccgccctggctttcagccgctcccagcgtctgtccacttccgcctgtatctctttcgctgtctgcctgtaggactcctctgtcaaatgacgtgtccttcccatcatcttcagccagtctgtgaccggaatctttttctcccgtttctccaggtcataactcagtgtggtgatcccattctctatctcatagagaggaaaatagcagcagttcaccgccgcctcaatgactcttctctctgtgttgggcttatctccccagtttagggggcaggcagagagtgtcttcacatatgccgttccgaaacgctgggcatacacctttgccttcgcggcttttttaataaaatccgcgggattggactccgccacagttgccacgtagggcagatttgtggctgccatgatcatcggcatatccttgtggaaaaaggtcttgccgtactgctcttttcctatatgggaggtggagcttttggcccctttgggggtggaataggagagctggtatcctgtattcatatatcccccgttgtcatactcgaaaatgatgagatggtcattcctgagagctgttccgagagcagaccccatgccgatgtccatgccgccgtctccgctgaccatcacaaaagtgatggcctcatccggcagttctccccgtcttctacgctgctgaaacgcctccacaacaccggccaaagttgcggcaccgttctggaacagattgtggatatagggtacacgaaaggctgtcttcggataagaggtggtgaccaccatgccgcatcctgtctggaacagcagaactacgtttccctctattccttttaacagcagattcacattgactggaatgccgcatcccgggcaggcaccgtgtccgggagccagtctttttggcatgactgtgctctcatttacccttcctccggatactttcacacggccattttcatctgcctcaccggaaatatatccggggcttgcctcctcccggctgataggtgcaaaatactgcttctcctccagttcctcatcccccggatagatacccagatagtcaaatccggcagcctgtccgtccagacactgcctgaacagctccagtgcatcctgcacataaaaatctcttcctccaagcccgtaaatgcggcttatgacccttgccttactgttgtggtccttaagggcagctttcagttccagggtcatatttcctccgcccgcaccgtagctgtcctgcctgtcagcagccagtatggtcaccgcacttttacagaggtcgtaaagctcttcggcgggaaagggtctcagggtatgaagtgtgaccacacccgccttgatgccttcctcccgcatccggtcggctgctgttttggctgtatggtaggaagaacccagcagaaacaagatcacctccgcgtcctcattcctgtacccctcaacaagaggatatttcctcccggatagggtttcatactctttcagcacccgggggatcactgtgcgtgcctgttccatggccaggtgaagctgatatttattattgagcgtatctggttcattcatataggagccgatagataccggatgttccagatccagcacagaatatctggcatcatactctcctataaattctcccaccgtacagtcatcctcaaacacatagcattttttcttctgatggctggtaaaaaagccgtcaaaggccacgatcaccggcagtctcaccatctccgcgatcttgatggcgcaaaggttcatatcatagaccgcctggggtgtatctgcaaacaggatcacccatccggtattcagtgtatacataatgtcactgtggtcgcctttgatggacagaggccctgacacagtcctgcacgccacattgagcaccatgggaaatctggtccccgactgtactggaagctgttctaaggcgtacagaagaccattggcgcttgtggcattgaacaccctggcacctgccgccgacgcgccgtaacagattcccgccgcgctgtgctctccttccgcggcaatgagggaaatatcatgctccccctccgctttcatcagatcaagaaactccgcaatctgtgtggaaggagtgatggggtaatatcccatcacatgataattgatctgttttgccgcaaaagctgccagttcatttccgctttcaaacaatactttttgtctctccatcaaaccagccctccgtcaattctccgttcttccaggtaggaatcactggtcacccaggaattcgcccctgcatcctcaaattctagatggtctgtgatcagatccttatttctcacaaaccatttcgggtcaggatgctctctttccaccccctgcaccagggcattcacaggacagacatccacacagcgcagacatcccttgcagtgatggtagtcaagccctttatttaccattgcctctctgcctttatactctcccttttcaaactggaagaccatatcaggacatgtggaatcacacaggccgcagttgatacatctgtcctggataaaaagaggaatatatccctctcttgacgctgaaaggtcattggagaccgtacttccgtaacgggtattgacgcctccctccggggcatttttgtacccccaccggttctgtacctccttataatggaccatttcatatttcccatcaggagtaaaatgttcctccttagccgcctcgtatccacgtttcacgccctccagattccgttccagaagtgcgggatactttctgcccagtgtatcccttaccagatcatacgccagctccaaagggataaaccccgcagcctttaccactgcccccagcatgaccatgttcacacggcttttgctctccatagcaatcttcagggcatccaccgcgtagatgctgcctccgtaaagtctcaacctttcccgcagcctgccaggagagtccggagagtttatcacaatcttcgtctcctccgtaacgcccgccgtaaccggcagcttaccggaaagggcttcatggaagagtcccaggatgtgaggcttttccaccggactgctgatacggatttctctgtccggtgcgcaccagcggataaatgcttttaccggtgaacctcgtttctcagaaccatagctggaaaaactggatgcgttaagccccatgtaagacgcccccagttcacctaaaagctttccgcacagatttgcccccaatccgcctatactctccagacgaatctcatagcatccctcttcattggcagtgggcagatttatttttttatccatctgtgatcactccttcctctcatttaccacttattatctataaaatcagaaaagttatacctccggcaccgcacataaacatcacaattcgcgggaatgactataatgcagaaaaggaggtaacacaatatgaatgaaccgcgtttttacggcagcgaagaatgcagcactctgatcgaggtgctctgcgcagatccgaaagccagcttttcctgctgccaaaaggagctgactgaactgaaagccaacacatcggaaggtgcctctgaaaagcatctccctgttgtggagcagaacggaaatgtcgtcaccgtcaatgtgggaagcatagcccatcctatgacagaggaacacagcatcggcttcatctgtctggaaactaaaaaaggcctccagagagtccgcttaaaagcagatggagaccctaaagcctgctttgcccttacagagggcgacaaaccggtggcagcctatgcgtactgcaacctgcacggattctggaagacagaaatccgttagaacaatccggatatacagaattccggataaacgaaactccggttcaaaaggagttaaaaccttttgaaccggagttttattatgctcaaatatgtcccaaccatacttctctatacgacttcatccagaaatacccctccgagagggcagatatcttctgtccccgcaggcaggttttcaggtatatggtagccaaaaagccaggatgtcagctcacgaatatggattcttataaccggggaaccgtctgtgctcttttttgcggctgtctcccgtaacacccgccggataacagaggtatgcctgtccaccgtccaagaaaacatgccccggttctcttccaactgctcatcctctacctccaggcagaaagtcatggaatcagcaggcgattgctccttcagacggatgaccgtcataaaatcaggcaggctcacgatccttgccataatagccggctttcctccgtctttttcccggtaaagggagggttctgccagcagcagccgctgctcctgtttttccaatccccatgtgccccgaaagccggctgtttttccttcctcctgtatctcctccaggattccgttctcgctttccatctctttgagaaggcgccttacatattctgcatcgcgcctggcaaagacttcatatctcttactcagccaagagttcatccattgcccagtcttctccatgaccgcctcagcgtccagactgctgagacggcgaaccgccacagcgctgtcctgcatccgcatggcgggcagttcccattccggctgatcgaagataaatgtaaaaccaaaaggaaggtagatttcttctgccgcaggcatgagaaaacagaatggcatcccctccgccctcatatccgacagcgccctgttcatgagcctgcgcatatatcctctgcgccgcccttctcttgccgtggcaacgcctactatataatcgcacttccacagcctgtccctaacataaacttcatagggatttctgtggagcatggagaggatcctgccattcttgcgaaggaccaggatcttattgtctttcgtcttttcttccatgtagtagtctgtaaagggtgcggaatcctccgggaaggcttcctcccaaaggcttctgcagctatttttctcagaactgttcagatacgccgtttccataccgcacctcacgcttctgccttgaaatcgatctgctttacttcatattttctggcgtatcccacaggattgtaagacatttttgcctttctgagcccctcgatccctaggtcgtcctcacggtttatcaaagccgcttccggaaattcggccaggaggaactgctggttaatgaactggtataacccccggatctcaggattggccttctctatatggatcacggccatattttccaggggattaaagcttccgatggtaaatgcctccagttttccgtcaatatagactccgcccatgcggacctgtagattggagcagttttttaggatctcgtggattccctccacctcatagtccagatgtgcctccacttcctcgcccttctgttctctccagtggtccaaaaacttccatacatcccctctgtcagaacagcagagccggcggtactcatacctgccctcataatccctcttaaatctattgagatggtttttctttttatgcagtttcttccctgagagggatctcatggcatctccgtcatagagataatcctttaagtcttcctgctctttcactaaaaatctgtccgtctgctccataagccccagggccataactgcctcctcatcggcgagatggatatataaaggctttttcagtacggtattaaagtattccacgatctcattgaaataatgttccaaatcttcctcactgcagataggcatggctgtcccagccacgccgtcattctccataagccactggatcgctttgccatcgctgcccgcaaactgaacgccgtaaagcttgctccaaataaaactgtcaagaaacacgctgtcacaggtcttgttgggtctcctgcaaaaaagaggtgtcaatctatctatatcttctgcttctaccggtttaaagtctaaattcattttgtcctccatatctgaattctgtatctgcctgcccttataaaaggcattctttgctgctattaatggtataacatttttttcagattatatactatattcagaaatatgaaaagggactttgtcacattttaatcgtaatttacctccacaggcatacctttctccgcggattccatgatagccaggatcgcaatggccgttcttctggcatcctccatggagacacggaattccctgccgtccaccagacggtcgataaaatcacggatactctcataagacaggcctttgcaccggtcaaatacacggttagataccagaatatccggagtgctggtattttcctctgtcacctcctgaatcaggttatggctggacagatccatattgatcattccttttgtgcagaggacgctgaatttgtaatcattcacattggtatttccgtttggtgtgatccagccattttccatctgggcaatgcctccatgctcaaattcaatggtggtgagataaatgtcttctgtgtctactcctaattcctccagaatccctttgcgttttaccgcatagacacgtttcacctcatccccgaagatccaccgcagggtatccaggctgtggcttcccaaaaaccagaggatagaggatctggaagcccaggaaagcatatcggttgccacccatttcacatcgctgtgccggatatagcccgtatagggagttcctaattttccagactccacctcctgctttgctgtgttaaagggagggttccatcggttgtgcagatctaccatacagcgcacatggttttcccggaccgccttgcagatcctttctatatcttccctggtggttgcaatgggcttctcgatcaatatgtccttccccgcattcgccattgccaccgcaatatccccatgggcaaaatccggtgtcactatggccaccgcgtccacctccgggtctgctgccaggctgtgatagtctgtatacaccttggcgatcccatatttgtccgcgatctccctggccctttcctcccggctgtcgcagatggccactgggctggcgcagatatgctctgcataaatagacgcatgcgtctgtccccaggtaccggctcccacaattcccattctgatttgcttcatctccatagatttaacctcctgtaaaaactatacatttatagtgtttgggatttctactgccatatgatctgcagctcatccaatagtgccttcatctccagcggcttcaccagataccctgtcattccggcttcataagcctgtatcttgtcctcatcaaaggcatttgccgtcatagccaggatcggaatctttccccctgttttcttttccagatcccgaatccttctggtggcttccagcccatccatgaccggcatgcggatatccatcaaaaccgccgaataatattcctgaggtgcctctgtatagatctccacggcttttgctccgttcacggcagtatccgtctgtatcccgtgcatctccagaagagactgggcaatctccctgttcaggtcattgtcttccaccaaaagcacacgccgttttccgaaatttgtctcctcttcctccggctccttgtcactgccgcagactgtccccagtcttgaaaacgtattgtaaatggtggagcggaaaagaggtttgggtatgaagaaattggcccccgcctttctggcctcctcctctatgctgctccagtcataggctgatataatgatgatcatggtttccgtcccggtgatttcacggatgcggcgcgttgtctctatgccgtccatatccggcattttccagtcaatcatggccacatctatggtccttccctgggatacagcaatgctcacctgttccaaagcctcacggccggatgacacccagatagaatgcgcgcctatctcctccaaaatgactgaggtctgttcacatacgatctcgtcgtcatccactaccaggacttccacatctttcataagctccctgtttttccgcctgaattcttcctcctcgtcatcatccaccagccccagagggatcgaaaccatgaatctgctgccccttcccttctggctctccacctggatcctgcctcccataagctgaaccaggttgaatacaatggaaagtcccagaccgcttcccacattatttctggcactctctgcgctctcctgttcaaaaggctggaatatacgctccttgaattcctcagacataccgataccgctgtcctcaacggtgatctgcacataggcatagccattggtacgcttctcttcccgggtgctcaccaggatctttccctgggcaggtgtgaatttcagcgcatttgagagcagattcatgagtatctgtttgatcctcagggcatctcccacataataatgctccataggctcaatctgtctggcctcaaagcctatcatggactccacagcctgaggataaataatagaggatatctcctcatacaattcagcgaaattgaattttctgctgttgatctccattttacccgtctctatcttggacatatcaagaatatcgttgatcaaggacagcagatatctggaggaggcgtcaatttttctgaagcagtcctgtactctgggcgtatcctcaattttcatctggccgatagtgctcattccgataatggcattcatgggcgttctgatatcatggctcattctggagagaaagtcagatttcgcgctgttggctgccttggcacctgccagggcatctctgagaagctgttcctgtctggcctgctccgctctctggctgtccagcacctttaccagctcgattgccagcacgtctgtccccacaggattatccacacagatgacctgtatggagatccagtggtaatccccgtcatatcccttttcctgcagttccatgtaaagctcacgctcaccggctgcgaatctttttataatagattccctggatgtgaacttttcaaaatcctcccggtaggaagggtagacatcaggggtggaaatcctcagcagttcatcatagatcccgcttctctcataaggacagatctgttcctcaatgaaacagttgtatgtattttttgtaaggttgatactcatgatcaatggatacgctgtacaggtggctgcccgcagggactggttctcgatccgctgctcttgttcctgggcctcctgcagaaggtgcatctgcgtaatatccgtaaaaattgcctggaccacgtcaagaccatccgcattgataaggcgttccatgatcacactgacccacataggcgaaccgtcatttttcctggactctcttgtataggtgatgatgccgctgcccacacggaggctgcggatctttgactcaatcttatcccgatcatgttccagagccatcaatagaggattatacaattccttcatataatcttcctctgagtgataaccatagaactcccagactctccggttgaaattgacaatgtggtgaggcggttccggctcaaactgcagaatgccgcaggggatagagttgtagagctgggtgagaaaacgcgcctgtctggctgcctctctgcctgcaagctgagcctgcagctcccgctccttcttctctgatatatcaccgatgaagcagtagatcacttcctccccttcctcatccgtaacctttttttcccatatcggatacccagaactggctgccgtcttttttggcaacacggtattccacattataggttcctctctcctccagactcgcctccgcctgctgcctcatggcggtataatcctcagaaagtataaaccctttacagcagcccccggtaaactcatcaaattcctcaggccctatgtatccaagaagatgacagagggcgtcgctgatccatttgacagaatactgctcatcttcccggcagatcagcattcccccgggaagctgggacagcatcagctctatctgtctgtccttattggccagagtttcttccagtttcctgtacgcctctttccccgcctggaccgggaaaagctctccctgctgtatatcggagaaatccacggaattatgaatatgaaccgttatcagctcatttttatctctgtccagcctgaagataaaagtgatcctctggtgcgtcttaaaatacagaccggtttcctcccttggctggatccagctctccccctcacagaaaaaatattcctctgtgagtgccctggtcacatactgctcgccgtacatatggcagggtgccagatcctcctttccttcccgaaagcaggctgccacagcctctttgccctctgccttctgctgcggccctgctcccagccatacgatatcatcatcaaatgtggatatgagaaactccacatctgactcgcaaaaatatcttctcaggatcagggaggcatatgcctccactctctgctgcatttcttcatacatatgataatctccttacagaaccggtactttgaccgtccaaaaatccttattgttatcattgtaacatttaatcctgtaggataccatagaaaaatccggctctgccttccattttaatggaaaacagaaccggattttttctgtctgtattacaaaaagccagaggcctctcttctgcacagttctttcataatgtcaggataccgtttatccagtctgtacaaaaccagcgtaacgatcactacgctccatacaaggaaagggccatacatgtatattttctgtatcatagctacagcactttccggctgtactatatttccatttgtagagctgacatatcccgccagggacaaaagccctgtcatggatgcagatgccagcccggagccaatcttggttcccactgatccgcctgcaaaaataagactttcctgacgaatgtgcgtcttccactgtccaaactccaccacatcccccagcatcccaaaaacaacggaattaagaggtgccagaccaatcccccgaatgatacagcaaaggagcatccattgaaaatgatctgggttgataaaaaagatacattggccgatcagagccaatactgcccctgccaaagacatattcctcttgccaaaccgtttgaggagaaacgggcagacaaaagtagcggatacaatggtcagtgtttctgttagatacaaagcactgtacatccacgtatcattgtggaaaatgtatttgcagtagtaaggcagaatggtgccggtcagtccataaataacattctgcatcatccataatatcagaactgcccaaaaatactgattacataccagggctttaaaagatttccccacaggtattttctcctgctttgcctgtgcttcgatctttacagtctcctcacacctaaaaaagcatatcagcagcagtcccaaggccagaaccgcccagatcgccatagtctttacccatgcggcctggtcattcccaaaaagctttacaagaggcatagtacaagtgaccgccagaattcggccgaatggcgacattcccatgcgcacaatgctgagcatatccctctcccctgactctctcgtcatcatagcggaaaggctgccatacggaagattgatagctgtatagcaaactgtggtacaaaaattataagtgacaaatatgtacagaaactgaactaatcccgttgtatggggtactgtaaacaacagcactgctgacaccgcataaggtacagccatccataatatccatggccttgattttccccatctggagtttgtccgctccacaagaagtcccataaccacatctgagaatccatcaaacacacgggagatcagcattaccattcccactgcagccgcagctacccccacatagtctgtataaaacagagtcagcagcgtactgatcataccaaaaacaacattacaggcagtatcaccgcacccgtaagaaacacgtgcagcaaaagatagtttccccctctccgcccccgcagagggtacattccccatttccttttccacaataaagtcctcccaatccttttatctatcgcttatatccgattttattttcccagaagttccctttcgatccgctcccgtgcctggggtgcctgcctgtccatcttctccggaaacccgaacatagagacacatgcaatgttgtcaccgcctgccttgggcgcgtccttcctcagttgtttatccgcgaactccatttttcttagagtctgaaaaatcccctcaaaatccacatctccctctcccatagccagatgctggtgtattgtcacgtccgcttttccccctttgttcagccacggcggattagcaatataacggcagtccaaggtctgattaaaggtgtctgcaaacaacacatgtgtcagttcatcacccgcataccgcagcatggaacgcacatcacctctgccttcatcataaaaaaatccgtgaggcgaagagtacacataaccaagattttttgaccggaaggattttaccatatcacaggtctcgttgttcagctcacaaaaatcataaggatgtgactgtatctccacacggattccctcccgctcaaaaatcggaagcagttcctccatggatctgaaccacatgccattacagatctcctgctgattgggatctcctgaaagctctgtattgataacctgaactcccatatccacagcgatctctatcatccgtttccaatttgccactgcaaactgccgctcctcctccgtgggcccggaccagcggtacaccacgataaaagaggagatctccactccggtttcccggagtgcctttctgtattccgcctcacattctttggaaaacagaggatgtttataaaacggattgatcctcggatgtggagactgttcaatgtatttatatccccagtctgccacctgatgtaccatccggttgatatccatctgctttgccagcacatccacgtcaaatgctattttcatctcatcagctccttatatctcttttacttgtagtccacccaggaagctccctgatctgcggaacgcacacagttttccacccagcgcacaccttctacaccggcatgaatgttagggtaccagaaatctacacttttcccttcatccgcagcagtcattgccagtgcaaaacggctgtatagattactccacgcctcaaacagaccctccggatgtccccctccgatcctgtcatcagccattgccgagagatgcagataatccatacctctttccaaaacttttaccggctccccctgtacttcaaaggtgagctggttcggcctttcatcccaccactccagagatgctttctcaccgataacccttattttctgtccatgcatggaaccgcagttcacacaggaagaccatacatatcccactgctccgttctcatactccataattgtcatagcattgtcttcaagaggtgcccttgatttaacgaaggactgtctgctgcacatcagccgtttgatcttcatatccggaagcatgacttcagataagtacagcggatgggttcccacatcacccagcacataggacggtcctgcaactttggggtcaactctccactttgtagacgctgtggtggcttccaccgccacattgtgaaacccgtgggaaaactgcatattaacgatacggatatcacccaatttcccatctgcgatcatctgccgtgcctcctcgatcatctgatgtccggcatatccataggtgatacccaccactttatttctcctgactgccagcttttccagctcctctgcctgttctgttgtaaaacaaagaggtttttcacaaatcacatgaagtcctgcctcaagcgctgcctttgtaatctcgtagtgggtaccgtttggcgtagccacagataccgcctggataccatcctctctctctgcctccctggcaaacatggtcttataatcgggatagcatctgtcttcactcacatgcagtttttttccaaaatccttccctctctccgggtcaatgtcaaaggcacctgcaaccaggtcaaaattaaaatctctcattgcggcagaccggtggatatagccaatctggcttccctttcctccccctaccatagcccagcggatcggtttttcaattttcttttctccgtaatacatagtctcattctccttttttatctttattctgttccgtcaaatctggtatccaacacttttcagatatgctacgctctctctcacgtcccgcagactggtatttgaatttcttgggtcccgctcctgttcgatcgtgatatatccgctatatccgatctcctccaaggctgctttgattcccggatagtccagacacccttttccaataggacacatagccccttctccgcatccttcaaagaaacggattttcttattcagcacatccctgtatactttttcactgacatccttaaagtgtacataatccaagcggtccgcatactttttcagccattctgccggatccatgccggagtaataaagatgccctgtatccaggcagagacctgccagctcataaggaatgtcccttaccaccgcttcgatctcatctgcaaactcaatataacctccagcatggggatggactacaggccgtactccatatatccttgcttttttgcatatccctctgatatgttccatcataatgccccactctttttcattcagccttggcgccgcatccggatgtcccgctgcataatccctttcatcatgcccccaatccataactgtaagataaggtgccgcaaaatgctgaccctcatgtaccggcagcggcggaagcgctgtcaccagtttgcatatttcctctgtctgcctgagtacattttcataattctcctcactcagcaaatcatcaaaaatagtccctgccacaatagccagtccattctttcccagctcccgggaaactctctttgcatcaaccggcagatatccataaggccccagttcaattgccctgtatcctgccagtccggcctcctcaagcaccctctcccaagccggcagatatggatttttcacgtcatccactccccagcagcacggtgccccgcaaatattcatactcatgctatttcctcccttttctgtgtgctatttctgtgtgctttctctgtgctcttttatgttcccattatatcccacctgctaaaagcacgccttcagtatcctgtaccatcttccccgccaaatccccgaaactcctttcagcctcccccttttttcctcagcatacttcactatcctgttcttcttctcttctgtctccctgaatccttcaaaccccctccaaatttgatactcctctaatataaaaaataagtgtggaagccaaagcctaaacaataagctttctcttccacacttatttactgaacggttactgatcttcatcctttcatgactggttacgaacccctttaagctcctccaaataaagtcccctataacgaatcggtgtcatccccactacctttgcaaacagagtacaaaaataattggtattgtcataccccaccgtagtagcaatctgtgtggcggtcatgtctgtagagatcagcagcgtctgtgccagtccgatcctccgccgtatcacatactgaataggggtacttcctgtcgcattcttaaatgcatgagacacataaggagctgagcaccccagagcttctgcaattttttccaggcttatctcctccgtataatgtttgttcagataattccatatcctagccacaaattgttcttccttcgtaccatctgccacagcctggggaaaagcctccaactggcttgccatcaccaccaatgaagcacacaaaagctgtgcggccagcctgccggtctgatttgtctcctgcatcatatacatctgcccgcacatttcttttaaaaggggatacatctgtcctgccttccgcacataaggtccttcttctcccacaagatgattccttggcagccctttgagtctgagattcgtgattcccacacaataagacccaatctcctcctccgttcctgaagatacttcatgcagatcatcctgattataaaaaagcacatccccttcttccagatgataagttacagcatttactgtataaatacctgtccccctgtaaataagcagcatctcacagatggactcatgactgtgcagcggtctgtccactctgattctattgattctctgtttatttatgtaaaccattgtgggcatgatccccccttcaaacacttcccccagattcctctgaatatccggccaaatcactaaaaacccctcccttatcaccctttttttctattatattatctgcctgcccacttggcaatcctcttctcccattccttcccacctcaaaaaaacacccggcacgatttctcatgccgggcgcaaaacatctgccgctgtagtttttatttatcgtacaaaaatttttccggcagatccacatgaaaatccaccgccaggtcccggaaattctgcgcagtgatggtctgaagcttatccggtctcatggacaacatctttacaaggatctccgcggacttttccactgtgtgcataagcccgaaggtcagatcaaaatcctcccctgagcagaacataccgtgatgtgcccaaatggccacatcgtattttttcatcagttcactggtggcggcagcgatctttcttcctcccggcaccatccatcccacaacaccgataccgtccgggaacaccaccgggcactctgttgccatctcccacagctctcttgtgaacacttcatcccttaagggcagcacaaaggtcagggcgatcacatttgtcgtatgggcatggtaaatcactctgtgctttccgcctgtagcctgcatcttcacctcgtggttcatcagatgggaaggcagttcactggtgggtcttcctccgtttaccaggccccagcagatacggtaattctctcccttgtcatctaactcgatcacagcaagggagtcctccggatctgtcataacattgcggaaatacttcccgcttcctgtcactagaaaatactctcccgccagagccggaaccgctgtaccgatctccttccagtccccgtcctctgacagctcttcccttacagactgcacttcctcttttttgatgcggtaagtcagatttccgccgtttctctcatgccatccctggttccagccgtcatctgccattctcataaaaccctgtacgaattttgcttccaaaactttcatttttctgttcctttctgtattgtgctgaggatttctctccttgtctgggcgtgtctgcgctttttcaggaacgtttgctcagcacctctttttcatactgctgcacttctttaaaccagtcctctttctcaggaacgccgcactgttcacagaaataattccatacatccccgaaaggatacagcttcagctcttcctggagcatcataagctctgtgaaggcgccgctgttctgcagtgctttcagtttgttgtttggctgaagcagggcaaacagaaatgctttctgcatattccgcattcccaccacccatgcgctgacgcggttaatactggcatcaaagaaatcaagccctaaaaataccctgtcaatggcatcgtttctcacaatttcctttgcgatctcctttgtctcgtcatcgaagagcacaacatgatcggaatcccagcgcaccggtcttgtcacgtgcagggccagtttctcattaaataagagcatagccggaattttatcggaaaccacctctgtgggatgataatgcccgttgtccatgagacttaaaatcccgttgttggctgcatagttgatgcagaattcactggaaccaaccgtgtaggactccatgccgatgccaaatacttttgattccaggcacacatagacttttgatctgtcatagtcaacggacaatatctgatcaagagaatccttgaacctggctcttggggacagacggtcagccggcacatccttatagccgtccgggatccagatattcatgacgcagggctgacccagctcctctgcaaaatactgggatatgcggatacaggcctgtccatggcggatccagaactgacggatctcctcatccggacttgagagggtaaagctctccgccttctcatgagaaaagaaggtgggattaaaatcaatgcccatacctctcttttttgcaaactctgcccatctcttaaaatgctccggttttaaggcatctctgtccgcaaaacagccgtcctcaaaaatggcatagttggcatgcagattcagcttatgctttcccgggatcagactcaaagccttgtcaatgtcctccatcagctcctccggtgttctggcctttcccgggtaatttcctgttgtctggataccgccggacaaaggaccttcgtggtcaaatccctgtacatcgtccccctgccagcagtgcatggaaatgtggatgtttttcagtgtctccactgccttgtctgtgtccacccccatatttttataaatttccctggctgattcatatctctgtgctgtagtcatatttttcctcctgactttatggtcaccgcagctgtcccgtgtctttacactccgtacagacagtgcaccttttctgttcctgttgccgttactgctgccgttacttttcatcttcacggctcatatacttgaattttaaaagagtcatagacacactgcctggctgcttttaagtctatccaaacgccttttgccatcatctgcaccatcagattgcccacagcagtggcctccgttgggcctgccagaacagtttttctggtactggaagcagtgagctgattcagatacgcggcgttggctccgccgcctactacatggagatgtctgtattgtatgcctgtcatctcctcaatctcaccaactgttctcccatagcagtctgcaaggcttctgtaaataacccctgcaagctgtcccggagtcatcggaacctgctgccctgtctcctcacagtattcctgcacagcctttgtcatggacaccggcgccagaaaacggccgtcattgcagtccacaagggacggaatctcctctttttctgccatttgacaaagctctgcaaaggaatagacatctcccagttcttttttgagggactggatcatccacaaccccataatatttttcaggtaacggaacctgtgagcataaccgccttcattggtaaaattcagcctccggcttttctccgtacagtccgcctgcccaagctctacccccatcaaagaccaggtgcctgaacttatgtataaagctttgtcatcctttgacggcacagccaaaaccgcggaacccgtgtcatgggtagccggcaggataacctgacagtcaaatcccacttctctttgtatctcttctgtaaagccgcccagcaccgtacccgcatcttgcacagattggaaaatccctttggggtatcccagtatttcaatcagttccatatcccagtcctttgtacgggggcttacaagctgtgtggtagtggcattggtgtattccgccgctttccttccggtcagcagaaattgaaaataatccggtatcatcagcatggcgtcggccttttccagatactccggatgcttttctttcactgccatgagctgataaatggtattgaatatctgtttctggattcctgttcttctatacagttctttttccggaaggatttcatagaccagacggtccatcccctctgttctcttatcccggtatcccaccgtattgcccagaaccctgccattctcatccaaaagcacaaaatccacagcccatgtatcaatccccatactcacaggtatcttcccggactctccgcactttttcagtcctgtcttgatctcctcaaataactgctccagatcccagcaggcctccccgtctttcatggtcagcccattgcggaagcgatggatctcctccatcaccatgcggccctgctccatatgccccagaatatgacgtccgctggacgctccgatgtccactgcaagataatattccgtcatcattttccacctccttatgcctctatcttaacgaaaaaggagggaaagaaaaagtacactgtttgcataattttataaccttatttgcagtctgccgattgcatttttttctccaccgtattaagataaagtcagaactgctccgcacagacaagagcaggaaaacgccgcactgctggatcggatcataaggggggataccatgaatcaagaacttctgaaggaactgaaaaaaataacagcggaggaacaggccctgttagatgggcagaaatgtatcaatccctccctctacaatctggaacactccatgaccattgacaacaaaaaacttctggaacacggaaagctcctggagatccgtccccatacccgttttgtccactttcccaagcataaccacaactacgtggaaatgatatatatgtgttccggcagcacccgccacttgataaacggctcagaggtccttctgggcaccggggaactcctctttttaagccagactgccacccaggaaatatatcccgcgggatatgacgacattgccgttaattttatcatcctgccggaatttttcggccagccccttggtatgatcggcacagaggacaatatgctgcgcacctttatcatcgaatgtctgaagaacggcagccagaatgtccattatcttcactttaaagctgcggatatcctgccgatccaaaaccttgtggaaaatctcatttggacgctgcacaacaaacagcccaacaagcgcagttccaaccaagtcaccatgggcctgctctttctgcagctcatgaattacattgacaaggctgagatcggacaggaaaattatgagcaggagctgctactcacagtgttccaatatatcgaggagcactacagcgacggggaactgtccacgctggcccaggaactgggctatgatctctattggctgagccgcgtcatcaagcggctgacaggaaaaaattacaaggatctgctccaggaaaaaagactgaaccaggcagcccacttgctccggaatacttccctcactgtgacagatatcggcctgcatgtgggataccacaatttcagttatttctacaaaatattcaaggcccgctacggcatgtctccccgttgttaccgccatttaaaagaacctgtatcccattaaaaaggcacatccgcccggtgccctgacagcgccggcgcggatgcgcctttttatttttctctctgatagagagccttcatcttatccttggctctgctgagtccttccatcaagagaggactgaagcagccgcattccccattgcgtatcatctcatacgctgtatcgtggggatatgcttttttgtatacacggtcactgaccagggcgtcatagacatctgccacagacaccacctgtgcctgaatagatatctcatctcccttcagcccgtccggatatccccgtccgtcccacctttcatggtgatggcggcagatatcatacgcatatttgtacacatggttctcgcggaaccgcggcacactgtccagaagctcacagccacgtatggtatgtgtcttcataatctcaaattcttccgctgtaagcctgcccggcttgttgagaatgccgtcaggaatggcgattttacccacgtcatgcatgactgcggcatctgctattattggcaggtcatcctcctcaatacagcaggacgggtccatctccttgatgacccgcagaagaatgagggtcagatcccgaatcctggtaacgtgctcaccggactcgcagtccctgaactcaatggccgtggagagcgtctcgatgatagaactgttcagctcccggatctcctgggcctgttccctcagcagcgcttcctgctcattcacaatgttgttgagccgtattacattgccgatccttcggcggatgaaaaagggaatgatcggctttccgataatatccacaacacccagttcataccctctttttaaaacttcctgagagttctctgctgttatcaaaaagacaggaatcttatgcgtcagctcaagcttctgcatctcttccagcacttcaaatccatccataacaggcataactacgtcaagcagtatggcggccagcctgtcctgctgctccatgataagctccatggcctgctttccgttttcagcttctaagattctgtaatcttccgaaaaggtagcatccaaaatcgcacggttcatttccacatcatctacaatcaaaattgtctgtctgttgttcataaacgccccaatgcctcctcccgaaagacttcagaagaactcccatgtctattgtccatcgtgcattaatcctttcatacactttttccttggtaaatccttcacttctatcagtttaacttctcttgcagaaaactgtcaagcgctatatgaaataataaaaaagatttcatacattacctgtattccccaaggaaaaacagtgccaccgtacccgggccggcatgggcgccgatcgtggctcctatagggttcatcattacatttgtaatgccgaacttttcttctacaagctttgccacatacgccgcgtcttcctcacagtctccatggctgatcaggacgatctcatttttatcccggtaagttcccactctctcttccatcatggacaccagggttgccagggattttttccgtcctctgacttttccaactggtatgagctttccttcattgtccacatggagcataggcttgatattcgccagtgttcccagaacagctgttgcctttgacacacgtccgccacggtatagatggtttaagtcatccacagtgaagacatgaccggtatgaagaatattttctttgacccactgcgccacttcctccatggactttccttcttccttcatcttaacagcataccacacaagcaggccttctcccatggacgcggccagagtgtcgatcacctccagctttctgtcaggataggagtctctaagctcttccgccgcaacacggcagctattgtaagtaccgctgagtccggatgagaatgccagatacagaacatccttcccctctttcagcacagactcaaaaatctcctctgctgctgtgggattcacctgcgatgtggtgggcatagagcctgccctcatacgcctgtaaaattctttatcctctataacatgctccttgtcataaatctccccgtccatattacaggacaggcagagataatccacctggtgttccttcagccatgctaagggcatatccactgtattatccgtcatgatcacataatcactcatacgctgtctccctcactttccattttaaacagtttaccacgaatcggccgtctcttcaactgaattccccttacattcctttgaccacctcgatcgccttctgaagctggttatcctctgactgctctattttcacctgctggcggagcccttcatccagctccacctccacatccggctggattcccgtgccatggatattgcgaccctttggtgtataatacttggcgatagtgagcttaacggcacttccgtctgtaagaggaatgggcatctgcacaataccttttccataagtggtagttcccaccagctttccgatcccgtaatcctgcacggcacctgagaagatttccgacgcgctggcgctgttttcattgacaagaacggtaagggggatctgcagttcatgttccccgtcacaggtatattcctttctgcccccattcttatcctctgtgtagacaataagaccctttggcagtatctgctccagaatatcacacacggagatcagcagccctccgggattgtcgcgaagatccacgatcaggcgctccatcccctgactctgcaggtcctgaaatgccgattcatactgggctgcagttacctctgcaaattcatagatctgaatatatccgatgtggtcctccagcatttcatgctccaccatagggacttccacatgttccaggggaatatccaggctcagataatcgctctcaccctccctggcgatctccaggtgggctgtcttgtcctctgaggctttgatgatctttaccacctctgtcagttccttgtctgtggtggtctccccgtttactttatagatcacgtctccgggcagcagtcctgccttggctcccggtgccccctcataacatctggtaatggagacgatccctgtcttggcgtcctgttgaagcactactcccacacccaggtattcgccccctgtgctctcgttgagctttgtatattcctccgaggtatagtatccggaataaggatcaccaagtcctgccaccagtcctttatacagataagactccagttcctccttatctatatcctccagataatattcgtctatgatcccctcgatcaacttggccttcttcacagtggaattattcacaacccccttctggttctgataccacagataaccggacactccgccgcctatcagcaccgtacagagaacacccagcagaaaccctttgatatatttctttctgtccactttttcagttcctttccacactcaaaataaaaaggagacaccgccaaacagtcctcccgccaacggggaggcagcatctgttcagcagcatctcttctgtactttataaattatacccttaaatgtttccttacagacatcatacttcctatgaaaccaataccgattccaagtcccacacctacaggaagcagaatacggaatacatgggatacatccaaaaactgcaggaatcctgacagaagatggaatcttgtcataacaaactcgatcaccttattatagagcacatagagaattcccatagggatcgccgcgcctacaatacccagcaggataccttcgatgacgaatggtgcccttacaaagaagtcagttgccccgatcagtttcatgataccaatctcttcctgccgcacagaaatgcccatggtaatggtattgctgatcaggaagaatgcaactgccagcagtataaatacaattgccagagacacatatccgatcaatttattaaacgtggatagtgtcttctccgctgactgtgactggctgacactgcgcacgccgtccagagattcaatatactctacaagctggctctgttcctcaacattcttcaggtatacctgatagttggctgagttggcgagaggattatcctgatttctgaagccctccgccagtgcctcgtcgccgcccagatagtcatcacggaactcttcccatgcctgatcggcagaaatgtattttacatccgcaacctcttcacgggccttgatcttctgaccgatgtcatcaatctgttcctgttttgttccctcgtcaaaatatacaacaaccgctacgccttcctccgctgtgtggacgatatatctaaagttcataaccagtgcaagaaacagtccaaacagaaagatacatgcggacatggtggcgatagaagcaagggagaatctcaagtttctccagatgttcttcacaccctgttttaatatgtatgctattgtactaattctcatactgatatccaccttcttgttcgtcgcttacaatgacgcctttcttcatggtaatcacccgcttcttaaatgcgttcacgatttccctgttgtgtgtaacgacaagaacggttgtaccgcgctcgttgatctcctccagcagcttcatgatctcaaaagagttcttagggtccaggttacctgtgggctcatccgcaagcaaaatacttggacggttcaccagcgcccttgccagggcaaccctctgctgctcaccgccggataactggtccggacgggatttgtatttttcagccaggcccactaaggtgagcacctcaggcacgcgctttttgatgacacgtgtgggacgctcgatgacccgctgcgcaaatgctacattttcatagacattcctgtcacgaagcagacggaaatcctggaatacaacaccgactcccctgcggtattttgccacttttctccgtcttaacttgtccaggcgctgtccgtttaccgtgatagacccgcttgtgggatccagttccttcaacagcagctttatcagagtggatttacctgagccgctgttgcccacgataaaaacaaattcacccttctctacgtgaagcgacacattgttaagagccggctggcccttactgtatgctttactcacgccctttaaatcaatcataaatatcctcctgtgttcccgatacccgcttccccggatatcagtaatcaagtgtctccatatacttcatatattttaccaccatcagggctatcttaaatgttatggcatcctcaaacacacgcaggtcaagaccggtactcttctggagcttgtccagccggtataccagggtattcctgtgtatgtacagctgtctcgatgtctctgagacattcaggctgttttcaaagaatttattgatggtggtcagtgtctcctcatcaaagtcatccggtgattttccatcgaaaatctcacggataaacattttgcaaagaggaatcggcagctggtagatcaatcggccgatgccaagggaactgtaggcgatcacttctctgtctccgaagaagatcttacccacatccagagccatacgcgcttccttgtaggagcgtgatacctcttttaactccttcacaatggtgccgtatgctatatgagtcctgccgtccttctcaatacccaaggtagtcaggatcatattcgcgatcttgtccacctgcggatagttgtccgtggcagtcagctcttttacaatgataatactcttctcgtctacagcagtgacaaaatccccagttttgccgcccaatagatttttaatattctccagagaaccgtagtccttatcctggttggtctccagaataaatacaactctgcgcacatccacttccacatgcagcttcttggcccggttatggatatccactaacagcagattgtccaaaagcagattcttaataaagttgtccttattaaaccgctctttatacgcggtcagcagtccctggatctggaaaaccacaagctttccaagtgtatagacatcgtctccggcgctattgataaccagcacatattccagctgatggtcatcgtagatcttaaagaactgataccctttgatcacctgactgtctgcctgggaatttgcaaaagctaaaacttcctcctgtgcacaaacattctcagaaaaagtagatgccatcactttcccttccatgtccgtgatgtagaagtctgttctggatatgcttttcagcccgtccagagtgttttgtagtacctggtttgatatcattctctttccttctttcattatatagtatatttccttgtttccatcccataaaaacaaaaaaccctacactatatactaatacataatcgaaaaaaaataaagagaaaatgttaaatattacatctttttttcaaaatgtaacattttgttcacattttcccttttctttttatgattcagacagaggaaaaaaactcacatttcttcaccgctgtggaatccctccccgatgacctcacgggcgtctgtgactatcacaaaagcttttggatcggttctggtaaccagctctttcagacgcacgatctgcttcttcccgaccacgcagaacagcatggttttttcctcaccggaatacatacccctggcagaaatccctgtaaggcccctctccagttcttccatgagactctttgcaagctcgtcgtgcaggtctgtgataataaacgcgatcttggcgaacttcataccttccagaaatccgtccgtcacctttgttgtgataaatatggcgatcaccgcatagagcgccctctgcagtccgaagacaaatacacctaatatgacaatagccccatccaccacctgcaggatctgggcaatggaataatggcgcatcttatgctggatcagcgcggaaaccatgtcggttccgcctgtagttccctgccccatgaagataaaaccaattcccactcccatgatcacaccgccgaacagagctgccagaagcatatcatccggtatgatgggaagttctggtatcagaaaaagccagagcgacagggcaagcgcaccgaagatagacttcttagtaaattcccacccctttatactcactccgaaaaagaacagcgggatattcaaaactgcattggtcagccacaggggaatcccgccgggcatcactttctcagtcaaagctttgatgataatggccagtccggaaaaacctccggtcaccatctgcatatggtcgtaaatggaagtgattgagacggccatcacagccgtcccgatcagtatatacacatatgcccgccaattcacttttttctcagcaagcatgctactcttctccttttcctgagtcctcgttctcctcattgtactgtgaaaccagctttttaaatgtactcttttccagaagttttcccagccagcctttttttaaccctgtttccttctggatctcctgccgttcacccaggcagaacaaaatttttgtattcatcatcttcctgttgtccgccacaaaacgctctatctccatatttctggagcatgtcagcaccacctgggggctgaaggagttgatctcattgataactctgtcaatctggtcagcatgggcctcctgcaggctgtctctcccgactatcacaatatccgggtatttatccttcacaaaattatagaacgcttccgtatcctcctctgtctcgcccagcagaaagacctggttcttataatgggacaaaaaccagaacagtgtggagaagaagccgtgcctggctgcctcctcttcaagcctggggtcctcaacacccgccgccttcagaacctccggctcatccaccacggccttgtccagaatgctgatatattccttgagcttctcatcctcctgggctgccatcagcagtttcatattgagcactccataagtggacagtgactccttataccaattctcattgacgtattccatcacgtcctctacataacatttctccacagaaatgccaagtacctctattttttcatgcataatatttctccagtgatcttctaccgcgctgccatccaccgccctgcaaaaacgcagtctgtgagcagcagcacgcttcgcacgcgctttatctacctactatagcagacaggcagagatttttcaagccacatatctcagtattcttcttctctcttttcctacactttgtattttcatccaaaagccgtcattccatgcgtctccagaaaagaaaatactgttttgtaatactcctgcggcgccttgtcaggtgcctgggcatgtccggcgccttccacgatcagcagttccttttcgcagtccgccgcgtcataaagcgtataagccatctccaccggaacgaacacatcctcctccccatgtataataagaagaggaatggagcttttcttcaccgcatccagggcggaggcttttttcagactatagccgccgcgtatctgcagcatcaggtctgccccatccaccaagggaaaacccgggagatgaaaccagtcctttaactgctttttaaaaatactgtacgcatctgtataggcactgtctgataccaccgcttttacattgtcaggcagatcctcccctgtcatcatcagggcgcaggcacctcccatggattgtccgtgtatgacgatcctggcatttttatcctttttcagtattgtttggagccacagcagattatcttttctgtccgtccagcccataccgataaaatccccttcgctctctccgctgcagcgcatatccggcaccaaaacctgatatcctctctcagcatattcaaaagcaatgggatacatctcctctttccatccggtataaccgtgcaaaagcagaacccagtcatggctttcgccctcctgatagaaagcccggcccagcagacggtatccgtcttctgttgtcaccgatacctcctcactgtccgctgacctgacccacttttctgttttctccaggctggccattttgttctgttcaatgtcatccgtctttacaagcgcttcatagctgtcctctgttatatcctcaaatgcctgagtctgttccatcttctcaggcaccagtgccagatccactactatattggacgcaagcaccaacagcgcaagcagtataagcactgcagcggccagtctttttatccattttttcttccgcatatatcaactgtcaccttgtagttttttgtcgtattttaattattatacctgctttttttcctgtgcgcaataatcgtctgataaaagcttttttgatcatttacactgttgctctgctttgttattataatactatacgaaaaacaaagtccagctaagaaatgtcaataggtaaaatgaaaaatgttaaaaaagtttttttcaagcagttgatgtaaaaaagggtaactttaataagcccacccatgtggaaatctttaaaattcatgataaacctgttaggctgcgttctgtatcttgtcgggatgcgctgccagataccgctcacagtgttcctgaggagtgatgatctcaaatggtttattatcccggagcatggcaaaaatgatattgcagattttatgcatgacagccccgacagccacgtttttcttcttgcttttgcatttgtcggtataatagccgtggataactggatttactggtgtttttgtccctttatccaccttaagattattgatagccaccatatgcaggatacgcctggcaaggctagaacccctcttggacatgtggactttatccccattgaacttgccggattgcttcacggcaggatccaagccgaagtaagcataaagcttctttggggaagaaaacaggtcaaaggagcccatttcagcgatcaggacggctgcactgagaaaaccgacaccacgtagggactggagaaggaagatacggtcataaaccggcgtcccttccagcttatcaacagccttatgcaggtcctcaagtatattgtccagatgctcctggtattcccggtaggttttgatatacagtcggatccggagtgcactgctttgaagcgcacgtccgaaaacagcggcgtcctttgcggcagcacgtatggcatcatatttggaaacggcatatttttcaccgaaacgtgcggttttgcgtatggtttccacaagtatgtcttttggggcggcaagcatgtctgcggcaagggggtaagcttccagaagctttaaggaagtttgggtagtgaccttgctaaacaccttccggtatgcaggaaaggacactttcagttccgccgtgagcttcaggacgacagcggactgcaggtctttgaagtaatagtagtcccgtaccaggttgcgcaggtcaatgacctcatcatctggtatgatggaagtcttaagggaagcatccaggccgactttggcagctttttttgaatcaaatttatcattatgcagtttccttacgttcatatttgtgctattcttagtgatgataggattaatgactgagcagtcaaaccccttatcacgaaggaagtacaggagcgggatgtggtagatcccggtggactcaaggaagcagcggctttcgagggaatacatctcttgtgcttcctttatttttgcgacagcaagctcacgggactgcggatcagaatgaatgatcttaaaaggtttcccggtgagaatgccattgggcagcatgatggacatccaggtgaagtctgcaccgacatcaagcccgactgagagataagggatgctttcaagcatcataagtacttttgggtatttcatggttttatcctttctggcaggcatccatttccaaaaggtggatacacaacctagcggtttatacaggtattagcctggggcttcccaaccagccaaaacataaatcaccaccgaatggactgacagactttctaagaggtttcaccagccggaaggccggttcccaaggaggtgtcgtcaatgatcctgcctccagtgattatacctctatcttttgtctggtgcattaaggaaacctcagacatggtaaataatgttactttataacttctgatggagggggaactcctccttccgttatatctatatagatttattagattggactttgtaactattaaccagtagtcattcttgactacaccattattatactaggaggtcttatatgcctcagtcggaaatattaaaaaaaatcatccaaaacatggagtccgtgatcgtggggaaacgccgggccatagagctggcactcatcacccttctctccgacggacacctgcttttggaggacgtgcccggggtggggaaaactactcttggaaaggcactggctcagtcagtccagtgcagctttgccagaattcagttcactccggatacacttcccggggatgtcatcggcatgtccatgtatcagatgcagaccggaaaattttcctatgttcccggagctgtaatgaatgacatccttttggcggatgagatcaaccgtacctccccaaaaacccaggcgagcctgttggaggccatggaggaacagcaggtcactgtggacggcatcacgtatgcccttcccgagttatttatggtcattgccacccagaaccctgtggaacaactgggcacctatcggctgcccgaggcacagcttgaccgttttatgatgaaaatttccatgggatacccggagacacctgcggacgaggcggatatcgtgcgccgtatggtagacggggagcctttgaaaaaattaagcccggtcactaccagagacgaacttatgcagatcaaggatgaggtcaaggcagtggctgtacatcaggatgtaatggcttacgcggttgagatcacaagaaacaccagaaaaagcagatatttatccctgggcgcaagccccagagccgccattgccctggtgcgcgctgccaaaagtcgagcctatctggagggccgcatgtacaccacaccggaagatattgccgctcttgctccgccggtgctgctgcaccggctgatcttatcttccgaggcacgactggagggaaaaaatgaaagggaaatgctgcaggaggccatgcgtgcagcacacgtacccgttttatgaaaaaagcggcctgtctgctttttatcataggcagcacagtgttggtaagctttcagggcaaagcggtttcctatctgctcttctacttttccctgctgctgcctctgctggcgcttctctactctctgtatgtttactttcgctttaaaatcgtacagaatgtagagcacttggtagtaaaagggcagaaagtcccctatcagctcattctcggcaatgaggattttcttccttttacagatataaccctgcatttttatacggatatggtcacaatgcagtacaacagtacagacccggaaccggagcatctgtgtcttctcccccatgaccagaagcggattgaaacacaaatgtactgcaggcacagaggcacttacccggtgggtgtgaaaagcgtcacagtcacggactttttaggactattcaccatcacttaccccatgatgtcccaggtacggctcacagccaaaccgcggatccttcctctggagcgcctcagtctggctcttaagaaaaaggatcccaagaacaccctgttccccaccacccgtctccagaacctgccggatcaccaggttcgccgctatcaaagcggagatcccaggaaatatatccattggaaaaactccgccaggacaggggagcttcttgtgcgcaagcagatgcccgaggaactttttgaaacagtcctcctgctggatttaagccctatccggggggattcggagatgcggctccaggcagaggacaatattctggaggcagccctctcctatctgcgggactgctgcctgaaaaacattcctgtccgggtagtctatatggatacggaaatccgggagcttctcatagatgtctgcaccggatttgatgccttttatgagaaatgcgcagatatttcttttgaatcccctctcccccttgagaaggtatggggccggtatgctgcccgcctggcaggtaccagagcctacatccttgtcacctcctcgcagtcacctgaacttacacggaccatagaggagagccgtattcttggtaatgaggtattgtgcatcaatgcaggagaattaagcttatgaaaaagtaccgggaatttattggtaaatattatgagagccttcacggggcctgtcttagcgcaggccttcttctgctggctgactctttctgggtcctgcactggccccccatgcttctgatcggaggcgctgtacttttctctctccttttccactatgcagtcaaaaaaaatgccctccttccgacaggctttatcttgctcgtcctgcatctggcaatttttattttctttcacctatccggcagagacttaggcatactccttccctatatccaaatagaggccgcctgtctcggagcatccgttctgtgtgtgaccgcagccgggcacctgtttatgacattacctatccttctggcagagcttgcctgtcttatctattatggaatccaagggatttccctgtccaaatggagcatctgcctggtatttttctgctgcctgctgtttttagccgaagctgcaggtcaaaaaagaggtatcaaaaagcaggatatctttttcctggcacctctgtttttcatgtgccttctcttcatctgtctgctccccgtgaaaaatacgcccatacgctgggaaactgtgagaagagctgcaggtgctgtacaggaaaaagcaaacgcgctgcttataaatctggatcatttcttttccggcacttcagacacctattccctgtcccgctccggatacggttcaaagggaaccctgggcggaagcctgatccaatcagataaccctcaaatctctgttacgggaactcagactaaatcccccctttatctggcgggaaccatctatgacacttacgacggaagttcctggacgccggaggagccttccggcagagaaaaaggaaaggaatacctggaacagtataagagtatcaatgaatctctgtctgtttccgggctgagtgatgaggaaatccgttcactgacccatctgtgtacaatggagataaaatttgaaggcctcaagacaaagagtctcttccatgccccaaatacctggaaatttcaactgccatcctctctggaagccgaatccagaggaggaaatattctcctcccaaaggcaaagggtgttggtttttcctacagcctgcagtttctggagctgaactataacagtgaggatttccaaaggcttctggccgtgacttccggttcccaaagggacagcgcccgccgttcccgcattgttaagaactgtaccgcccttccggatgatcttccccgacgggtatacgatcttgcagaagaacttaccatggggtgtcagacacctctggaggaactaaaagccatccgggcatatctggcagactaccagtattccaccacagcggatgcaccagcagaaggacaggattttgtcgactcttttctctttgacaccaaaaccggttactgcacatcctttgccactgccatggctgtcctcggacgctgccggggaattcccacccgatatgtggagggctttgccaatgaccggacatgcagtgaggataagacggaaatccatctgagcggttccaacgcccatgcatgggcagaggcctatctggagcctgtgggctgggttccctttgactccacacccggctatgcctccggcgcgggttctgtctgggaagcagaatccgtggatgactctgatacccctatttccacaggcccgggcagcagcggtttggtcaccgggacagaggatcacagcaccgaatctgccggggattccgggacaatggaggacatttataccaaccttctgcaagtactgctaaagctccttcctattatccttctccttgcagccgtctgccttatggctgcggcagcagttctgttccgtaaatttatgcggcacagagcatatgtctccatgagcagctatgaaaaaatacttttcctcatggacagactgtttctgctgggcaggctgtcaggtatttcctttgaagagggggagactctgcttgaatacgaagaaaagaccgccggtgcccttgacacacctgagacggccttaactgaaatattccgtatgttccgtgagattcgctacggaggacaaaaagcctccccggaaactgtatcacttttaaaagcttatatccgctcactggaaacgcagtatctccaaagctgctcccgcaccaagcgtctgctgtactgcctccggtaaacacggcatctgccgcatcagcggttttccggatccggcctctttctccaaattcttgaggcgtcctctaccgctattaagatcacaccccgtttttttgacagatatccttcagacaacatttttcacagtccggctttgttctggctgtacagacatccctgccatggaacaccagtctgtgacagaaatcgcttccctctttgggagggatcagtttccacagcgccatctctacttttttgggatcttttataccgtccaccaatccaatacggttgaccagtcggatacagtgcgtatctgtcacgatggcaggctccccgaatacatctcccatgatcagattggcgctttttctccccactcccgggagctttaaaagggcgttaaagtcattcggcactctgccgccatattcatctctcaggattttcatacaggcactgatatccctggctttacttttcccaagaccacagggcctcacgatctgctcaatgtccgccgcatctgcatcagccaaagcattgacatccgggtatttcgcatacagatcctgtaccaccacattgactctggcgtccgtgcactgggctgccaggcggacactgacaagcagcttccacgcctggtcataatccagggtacatcccacatcggggtattccttttttaatctctccactgtttccagtgccagttcctcttttgtcatattctctctccctttcacagttgtcggttcaagttctttcttctacccctttctcaattatggttcagactcttccttccacacttttttgtgcagacaattctttctttataatttgaaaaagttcatcgtttaccttaaccagtccgccatatccgcatgtatagcgcatggtccaataggttcccacaagtttttctgttttgtatcctgttcggatcataaccagagggacggacagccgctctctctttatatatacatctttgatagtttttctgtaaatcctttcaaccagagtcagatcataagaattccactgatagatccactcatctgtcaggatacaggccagccttttcagactgaaccttccaaatatctcctccacatgactcagataccggtccacctgttccttttccctctcagaaagtgtgccccaaaatatgcaaagtgccctgaggttttcccccgcacactgcttatggatacaaacagccacgcccaatacaacggaagcaggaatgatgagtgccagtctgaacagaataccggagagttccctgccccctgcggctaactcatatactgtcctgcagatttggtaaaaaagaaagatgccggcagccaaaaagaaaatccttgtaaactttgcttctctttttctgttgtgtatcattttttccataaaccgcctcatttaacaaaggcacttccgataactttccatatcaagtttcggaaaatgcctctgtttttcagtctttcttgtgtgctgccgcctttctcagcacctggtacagatactctgcatccaccggttttgccacgaatccgctcatacctgctgcttccgctgcgtccacatcctccttaaaagcattggcggtcatggcgataataggaacagcggctgcgtcttccttgtcaaggcttctgatctctcttgccgcttccaacccattcatgacaggcatctggatatccatgaggattgcctggatatcccccggcctgctgcggctgaatatctccaccgcctcttttccatctctggcccgggtcacatcagccccctgtatcttcagcagttcacaggcaatatccgcattcaggtcattatcttcagccagaaggatttgagcatccacaaggcacagctcctctgcctgttccggacttttctccttttcctcctctacatcaccaacaggaatttttatggtaaaataaaactcactgccctgtcccgattcgcttttcagtttcagttcacctcccataagctgcacaatatttctgcttatggcgagtcccagtccggttccctggcttctggcagaactggtacccgcctgctcaaaggcctcaaagatacgctgcctgttctcttctgaaatcccggtgccattgtcaactactctaaacttatacacagcattttgccctgtctttcctgtctgctgcacatacagacgcacatggcctccggccggcgtaaatttaaaggcattggagatcaggttcatgagcacctgtttcagccgcaccgcatcccctactaatctgtcatctctgatatccctgtgtatctcaaactccaacccgtgtttacgggcttccattgtcatgatattctgtatttcctccacgatctgtactgcggagaaaggctcggcgtcaatggtcatcatctcactctcgatcctgctcatatccaaaatatcactgataagactcagaagataatgggaggaatcccggatctttgtcagattatctcttacgtcctcaggcacatcatccatcatacaagtcagatcactcaacccgacaatggcattcattggggtacggatttcatgactcattctggacaggaattccccttttgctttgctggctgcctctgctttttccaggctgatctgcatttcagcggagcgcacacggctgcgtgccgccatcagaacaagaaataccaccagcacaaagacacatacgatcactgtaataaacaataccggattggcatacagcagatccaccacagtcagcgaggtgacacctgcggacatcatattctggtttaccagggtatcctttttatcactgctcatgctgttgatcgccttattcatagcggtcagcagatctgtttccgcagggcttttcattgcaaatctgatctcatttacgttgtttaccagggtgttcggcactacatttgtataatgatgcttctgcatctcttcttccatattggctgagagtccgtagaaaaaatccgcttctccccggttgactgcggaaagcgcctctgcaacattgcggtaatagatcactttatcagtctctatgcttcctggcatctggcgtccctccagcactgcgccaaccaggccctttgaaggaaagctgactgatttgttcctggttatgatatcattcaaattgccgtaggtctgggtcagagccagatccatttctatgctctcctcctcagttcccaaaaaggcccccagtatgtctgcctccccctccagcaccagcttcagtgctttcgcgtatgattcagcatagacatagctgaactcaaggccggtgaatttcctgacctcctccagtacatcaacgatcaatccgttgtgaaactcctctgcatattcttcacagaacagcggatgccagtcctttaccactgcaacagacactgttttcttttgtttgatatacgcccgttctccatcattcaggtatatgctggcctttccgctgtcggtgaaattagcctggtaacgttcctccgcaaaattaggattggaatccaatatattttccagtgccatattcaatccatccaatatttcctgattccccggtacagtcacaatataatggggctgggagtcaaaggtggcaacgggacgaaatatttccgtgtcctccgcactgttgccgagtatcatatctatttctcccttctccagataaggatagagattgccgtcctggagctggtccttgctgtaatatcggatggtacagccaattccattgctctctataaactgtttcagcctacggatattttcccgggcattttcataaacgccaatgcttttcccctccatgcttctccagtcaaatgccttgatgctgctgtcatccctgcgcgccagaagaacagattttccaaatcccgtattataatcaggataggcaaagtattcctccatgccctccagataataggttccccccatcagatcatattcaccgttcagaaacttttctgtcagggtttcaccgtcggcactgatatattcgtatttccatccggtatactttgcaatttcattcagataatccaccacaataccgtgtctggttccgtcagcgcttgtctcggtgaatccctccacctccggaaatgccacgcgcagagtcttatcctctttgttttcttctgcccaaaccatattacatggcagaaggaccgcaaaaaataataaggccagcataaccagcagtctgatgccttttttcggcatctgtgatttttctctcatactcagaaactccttttatccccggcagtcttatttaaacagtgtttccgcctttttcattttttcagtgaccttgacgccaaaagggcagttcttctcgcagccgccgcactccacacattccctgccgtttgctgacagccccttatagtgagctttaagagccgcaggaacctccggctgcatcacggccagatcatagagtttgctgaccattgcaatgtcgattccggatgggcacggggcacagtgaccgcagtaagtgcactgtccgtagtaggcatgtaccggagcgttggcaagaaccgtggcataatccttttcctcctcagatgccgtttcatatgccacagcctgatctacatgttccggtgtatcatatcccaccattacactggcagtccccggacgtgtcagggcatagtgcagacactgcacaggggtaagcgcggttttaaagggagacgtctctgccgagaacagacgtcctccggcatatcccttcatgacagtaatacccactccgtttttctcacagatcttgtacagctctgcccgttcaggggcaattccgcccagaccctcatcatagttttccttgaaatattctgttatatcgtcactggcaggaagcatatcaaaagccggattgatgctgaacaatatcatctcgatcctgccgcttaaggcagccagctttgcaactgcgggattatgggtactcattcccatatgtcgtattatacccttttctttcaagcttctggcatattcatagaattccccatccataatacgccggaattcttcctcctcatctacaaaatgaaggatacccaaatctatgtaatctgtccccaggcgatccataagatcaaaaaaagctgtcttcgcctgcccgatatcgcgggttctcacatactgcccgttctgccaggtagatcccagatgtccctggatgatccagcgctctcttctgcctttgatggctgcgcctatattagacctcacattaggctccgacatccagcagtccagaatattgattcccgctttctcacagcgcaggatcacttcctggacctcccgggcgttgtggcgctccagccactctgccccaagtccaatctcactgacttttaatccggttttccctagttctctgtatcgcatttttcactcacctttccataacgggcagaaaaagactgcgttactccctgtttatgttcccctgccatattatttctattcctgcggactcagggcaaaattccatataacgcataaaaccatgcccttcgatgggatagcttcatacatttttcaacttctttcggctttaaccattactttttttattataacataaaataatgcagtcattccataattttccaagatcatgtaatggctgcattaatttttttctgccgtttttggcaggggtcccgctactgaggaccgatatcttcccattgattcttctttttccatatacagcagcttaccaaagctttttttaactgttctatagagatgggttttgccagatgtccattcatacctgccagacgcgcgcttttaacatcctcagaaaaagcgtctgctgtcatggcataaatgggaagctcactgatcctttccataccggaactacggatctcccgggccgcctcgtatccatttttaaccggcatctgtatatccatgaagacgatatcgtaatagagaggcgcatgggtaaggactgcctccactgcctgcttaccatcctctaccacctctgcctgtacccccagaagctccagcatctccacagcgatctgccggttcagctcattgtcctccgcaagaagaactctgaggtttgcaaagccggagatatcctccatcttttcttctgtagggacggagacggttccataacattttgtcatacacaatgtgaccaaaaattcagaaccttttccatactcgctctccacctcaatagtaccgtccatcatagaaacaatattttttacgatcgtcatcccaagcccggtgccggtaaccttgctggtccggctgtcctccgctctgctgaaaggctcaaagatatgttccagatactcaggtttcataccaatgccgttatccttgatcagaaaatggtaggtccctgctctctgctcttccttgcgctcctctcggacaataagagaaatcctgcctcccttatctgtatacttggacgcattttccaaaatattcaccaacacctgtttcagtctcctggcatctcctgccacctgggtatgagtcccctcttccacttcagcgaaaaacgtctggtttttcctttcaagagaaatgcgcacaatctctgacacctcttccaccagacttttcaagtcaaattccctctcctccagttccacggtaccgctttcaattttactgacgtccagcacttcgttgatcaatcccagcagatgagcgccggagctttgtatctttgtaaaatagtcctttaatcgttccgtttcctctaaatggagctgtgccagctccgtcattcccacaattgcgttgagaggggtccggatatcatggctcattcttgacaggaagtcactttttgcctgactggccttctccgctttctgcagcgcatcttccaacagttgttttgcccttctctctttttcaagggtttcctgctggatcctgcgttcccagtcaatatttcttgacagagtgacttcgaccaggtcatctgtatatgggctgtccaccctcactacctgtgtaaaataccagtgacagcttccgtcctctcccatatgaggcacttccattgatacaatacgctttccctgggcaaatgcactgaccagagaaaaataggagaatttctccaagaacttctccctgtgatcaggatggaccccggcagcctcagactccatcagttcatcaaaatcaccttcatccccgggacgagcaacagaatagcgctcatattcaagcatatggtaggtctttttagtcaggttcacagatatgagcatctgatacgcaaatcctgcggctgttgccaactggctgatttccagattgcgctgctgctcctgcagaaattcctcctgtatatcacggaataccaggatacaccagcattccttttcccccagcttatccaccctggctgcggtaaattccaccatgtgatagtttccttctgctgtaagtcggcgcatacgcctggatatctgcttttttccttccccaaagagacgcagcatggcctcccgggaaaagttctcgtgaaaaagctccagatcatcgggatgtactaccttttttgcgtaattataattttctgccccgaaatttccctgctccggtatatccgtccacattacatccttctgacaattaacataataatccgtagtcagatttgcaatgatacattcatcaaatatagtcacaaggctctgggcatacatctgctcaatattctgtatccactgcttttcctcaaaattcggagtgtgaggcgtggatgtgatcaccactgccgggatatttccatcccagtttgttctgtctgctgtcacatccactgtgttcttcaacagcggatcataacagacaatatggctggaattcccactgcccatagctctgaccggacaattaccgcatagctcaggccagatttcatgacattttgctcccagcacagctctgccgcggccggtctttctgcagcgctgattgcaatacaaaagccggtggcttttctcctctatgacataaatactggtctcactcaaagaatccagcagattcctcagattatccccggacatgcggttccctcctcattttgtttctgtgacatatcatcagttgtcttcctgcagcatgaaaaatttatatgattatctatcacttaaataaaaagaggcatttacgaacctggtaagaatcgtaatgcctcccggcttcgcctatatttatctactttttcagcttgaattttccaatcagttctttcagaagctgtgcctgtgcggaaagttcctcactggcagctgcgctttcttccgcagtacctgaattcatctggaccacaccggaaatctggtcaatcccccgggcaacctgttccgcagaacgagcctgatcaccggatgcctcggaaattttgtcgatggaatcagccacttctcctacgccctccaccacacgtttcagcatcgccgccgtctcatccgcaagctttgcgccgttttccacagcttttagcgagccttctatcagcacggtagtatctcgggatgcctccgcgctcttggttgcaagatttctcacctcgcccgccactacggcaaatcctctgccactctccccggctctggcagcttccacagaggcattcagtgccaatatattggtttggaacgcaatatcctcaatggctttgacgatattgccgatttcatatgaccttttcttaagctcctgcattgcttccagcatttcctgcatacgggtgttgctcctggcagcctctctgcccacatccgccactctgctgtttgccgttgccgcattgtcggcattggcagacacttgttctgatatttcgctgatactctctgccagttcttccactgctcccgcctgttctgacgctccctgtgccagagactgcgcaccttctgatacctgctcagaaccgcaggaaacctgttccgcagaggcattgatctgacccagagtcaaattcaatgattcaatgatctgttccagtgcctcccgtatgaagcggaaatcaccgatatagttatctctcaccgtcacgtccaggttaccgccggaaatctcactcaatacatgtgtgacatcatgtatcatctctttcaaagtgctgacagaagtacggatgctcacagccatgcggccaatttcatcatttccgtactctttaatggaaacttccaggttaccttctgaaaactcctgcatactgccgctgatttccaccaaaggcttcatcatcctgcgggtgatcaccataataaccatcatgagaatccctatcatgataacagacagcgcagccagtgcggcgatcagatgattacgtgtagcatttacctctgaaacaggcagtgtggcaatcgccagccatcccgttgtcccgcagtttctgaacatggaggtataggctgtatcactgtattcaaaattaaagattccgttatagttactctttacattttctttatagtcatctgatatgttcagctcttcgacatttttccccatagccgcagggtcatcgctgtatatgtagtccgcgctgccggaaagcacctccaggtacccattttcccctacttttatctctgagagaagctgcgaaagactgctgacatagacatcaaaccccacaaatccctcaatctttaaattgtcttcagaaaatacaggggaaactacagagattatggattctcctgtggccggatccagataaggctcagatacaaccggcttcttttcatcaagcaccggctgacgccataccacatccgccagattcgcagccactgcctctccatttgagagcaggtaacagtcagtcttgtcatctgcgacccatacctgcaaaacattttcatccctcatgcgttccagggcaccggacagttccttcaggactatatccttctccttatatttttcaatatcttctgccgtattgacagctctaaaataagactggaggtcatcgctcttctcaaacatactgactgctgctgttttactcttaaaaaaatcatccacaatagaaaccgcataatctgtctgcacgtccagaagctcatcattgagatctgaaatattattggccgccacgatacaggatataatgatcagtatgaccaatgacggaatcagaacgatcagcaggctcccagtgattcttgtggagatggacttttctctctgttttacagcctcctctccatgagtgttttcacggtttaaaatatttgacattctttccccccatagtcatggcattggcttatcacggcatacagcagctcaattccattgcgtatttaataactttacatacaaaatattatatcatatgccttacaaaaggaaaagaaaatcatctttccattgtcagttctaagcatttccagtcttccttcattacatgatacgtctccacactatcggagatcagttcctgaaatcctgctgctctatagcaatgataagctgaggggttattttcaaatactcccagcgaaacttttctggcaccgtaaatttcaaatgcaaacttcactccctgctgtatcattgcttttccgtaacctttaccacgcttaactgggtctaggatcacatatccaaaacgcagttcatctaaggaactaccggggtttctaaaagtaaaaaagcccacaatgccagattcgtcaaatgcggtaaaaggcatcaatgatttcacagaattaaattctttctccgtaatgggatagtttccaagcatccctgctgtccatttataaaaatccgcttcatttttacaccaggataggatctcacaggcatccgtatctttgtaaggtcttaatctgatcatttttgcgcctttctaattctattttctgtaccgagtttcatttattaagcttaggattaaagcttttgaatgtgatgaaccgccggatcatcctactgccagtgcctactctgtaaataaaatctgtaaatcaatatcttcgcagtcatatcccacaagtttcaatctattctgcccgggcgttaatgatacggtttttgttacaaatccatctgttgaagtttcaggcaaacactcaattactgtttccacacttccctcgtcatcaatatgtactacttttgcttttccttttgaaagactaaaagaaaaatccatctccatatcctgtgcctcatccgtcatatctgaccatattgtttcacgtccgtcaaatttagaaaccgtaatggaacatcctgtatcggttgtatttgctacggatctttctttggcataatggtcttctgcttttgcaatcttttcggcagattcgtattctgctttagcaaatccattactacatcctgatacggacaaacacagcaatactgctaaaacaatgcgcactttcttcatgccttttaacatcttttcaacttttccttccacataaattggggatttccctctaaattcagtttactatatctaaggcaatgcgtctagaattaaggtttccgcatgagaagcacggcggtttcaacatacgatagttaggctattccgcataacttatccccagcataaaatcagccgtaattactggtgtttttaaccattctgtcatcacagcccttgtgcttttgattaggctatttagtgatattcagatatctctttacgtaatctgtgtcaaaccagttttttgcagcaactcattatctgaatctgcctaattattaaatcacgcaacaataccacctttctaatcacatttatcctcagtatgccctcttcatatttaacggtattcctcagacccctctcatcccgaactgcctcaaaagctttttagtattatcaaagggagtcctttcccgttgtatagcaaacattactctttaaatatatctcgaagactgtcaattacggtttttaaatttgcaaatacactccgtaatatttcgtcgtctaaagaacatagataatcacaaaatttcattttttcgaaatttttaataatattgtcatcaccataatctccctcttttacttttgtagaataaaatgaatctgtatcaacttcatcaagtactaaagcattttcaattccgattttcattcgcttcgagttgttataaaaaggtattactttagtatagatattgttttttactgtttccatacgtctcgtgtcacaatcaaataaacatacttgtttttgtgcaagattacgaccaatcaaaaattgagctgccttattcaaagcatcttttcctgtgttttcttcatttttctcatctttcatatatccgacccagtggaactcaaaaggcaaatgattatacccaaatacattaacagcttttctaaaatacttctcgtctgttctcccttcaaggtatactgacgaattctctggaacaaaattccgaataaaaaaagcatctttaacagcttctacagatgtacatttgaaatactcaggtttatcgcttacacatatttcaccagattgatttcgagttaaaacaattactttatcattctttctgttctcattatgaattacaaaaggagaatgggtaaccgaaaaaatttgagatgtttgtttaccaaatgtatcagtaaatatgccagtgtaataatccatgattttactctgccagttgggatgcaaactaatttccggttcatcaataaacacaaatgcgccatttattgcatttacatcctttaataaaaaacagcctctatatactatctgtttttcccccgaacttagaacatcaatagggatttcccttccatatttcataaaaataatagccttatagttatttcgattttcgacatggctataggacaagcattctaacattctgttgaaagcgctcgtaaaacgtggaatttttcgttctagaacaagatctttgcataaaacatccggatgttcttgaacagcacgattaacagcactatcatcttgtgcctgaatgtcaatgagaagttggtttatttcctgtggaagattattggacgattttcgactttcctgtttgtcatccagtgaaaggctggtaacagacgaaagctgatttgaatggaaattaatatccacatccgaataaatgccatgaaattgatatctatttttgatatcttcagaatcaatgtaaacattcatgccttgtccatcgtcagcataccaaagtgaatttgcgttgtgactctcccttaaataatattttatataaaataatgtgccattattttcaaaactgactttcatctcacagttaaccgtatgtgaagccaccctatacaactcattgagtatagtactttttccatttccattttcccctgcaaaaatcactgtgtctacggctttcccatttgaatcacaaaaatttaaatataaattaccgagaacaggatgatttgcaaatgtcacttctcgaattttgtacatttataaattccttctttcgtttaaaaaacttttattgcaaaattaacaacaatctatttctttgaattataccttctattttttctattacttccgctctcacctctcacaacattactcctcctcgccttctccatcttcacagcctcaaaaacctctttcactattatcgcaggattattatccgatgccaaataatgaacatcacttttcccagactttaataacaaaacatcacctgtatacttctaattacacagcataacatctattatccttttacatcatttctcttttccggtaggtgatggtatttcccgcttttcaagttccctaataatccccaaaacgctctttccaccaagatacaaatcaaatatcagatcaacattcgccgccgtttccacatcaatagtcaatttaccattctcatcatgcttgtacctgtagcacttcctatcatacaacttcgatgtaccagcggttgcacgatatttgattccccttttaatattgtcacttctggactggttctctgcttgtgccaaagattcaataatagctatcatcaaatcactatccgtctttgccgtatccagttcttcctgttcaaatatcactctcacaccaagctgccttaattgattcagcgcatccagtatttcaactgtatctcttccaaacctgctgatactttttgtcagaataatattcaatttataagctttaccgtcatcaatcatacgattaaatttttttcgtgatgaacctgttttactggtagcaatatccatataaacgtctgacagaagccattgtggcatagcccctgtcaattttgtcaaatgagacacctgagctgtcaggctttgtaattgttctgcactgttggtactgacacggcaataaatacctactttctcttctctctttggaatcggaggtatgtagtgtattcttgaattttcccgcatatttattctcctctgctccacgcctatttatcataagtttattatctccgcatagtgattggtcaatttcaaccatactgtcaactcaacctagtaaatatccatcctatctccacaacctacccaatatccattctgtcaactcaactatccgtattgatatgttcccatgccctaattttacaggtattttcgtaatctcaatgtacgcaaaaatcacaatctatttttttaatgccttgttttctagccttttgcgtacatttatttctccacccgtgacatcaacacgcagacctccacatgcggtgggacggatattttatactacatggcaaaagaattattatgcaaaagtaacgggagcaatttttcttatccatttccccccatttaccccttttgaatcaaaatcacccccttataaagcttttaccccctttactaattttctaaccgtaattactatttgttaaaaaacaggatgttaattttctcttttcttatcatattctaacgcatcatactctctctgcaattctcgtaataattcctcttcacttggcaaatatagcttatattttgaagcgaaaatctgtgtttcattttctggcaacgtatacttaactacagattcacttttatccgcacacagtacaattcctataggaggattgtctccttcattcatcaattcacgttcatagtaatgtacatacatctgcatctgtcctaaatcctgatgtgtcaagtctccaatttttaaatcaattagtacaaagcatttcaaaatataattataaaagacaaggtctattcggaaatgtcgcccatcaaatgtaatcctcttctgtcttgcaacaaacgaaaatccccgccccaattccaatagaaacttttgcaaatgcgtaatcaaagcttcctctaaatcattctcataaaaatcatcattaggatttagaccaagaaactctaatacatatggatcacgaataatatcctctggcacttttgccggttctaatttcagaatttcttctgtaaccttttctttgttttgactggaaagcaatctttcataaaaaaatgaattaatttgcctttcaagctgtcgtgtactccaattcgattttattgcctcttcggtgtaaaactgacgagcattttcattttccacacgcataagcagacgataatgcgtccaactcaattcgtcacgcagtgcgtgactattcggaaatgtcagataaaactgtctcatgtattttagattagtaggcgtaaacccttttccaaaatccaaagtcatctgtttggataattccgctattaatctacttccatactccgctttctcgtatccatcctgctgttccactatactttttcctatattccagtatgcttcaaccattgcaaagtttgcagtttgatatactttgtttctggctttagaaagaattcttttaatttgttcataaaattgttgttccatttcattcctcctacaactacattttaaattcaaggaataattagctcttcgctacggtatattggctttattgcagtttctaacacaaaaatatttttcttgtgtaaacacattcaataaacttgttgtaatgttatttaaaactatctcttttgttacttggattaatttatccttaccaaatacattactaatgccctttaatgatttcttccctttacatgtttcaaacaactgctgaaagaatgaagcaattgaaacgataaccctatcccacatcatattatcgtaaaatagtattccatctttatattccaacataagaagctcaccttcacctgaatatttccattttctatagttctgcaaatcattaataaaactaacaaacattttatcactataagaccaatctacaccatttatttttgttactacttgtccatccggataggttccataccagtatgctccatatcccgacaaatagaaatttgtattatgtccacttagatgatgatattaatttaagctattcaaaatgctttttccaacctctaaatatgtctaattatttactttcttctttaatatctcatcaataaggctcatatattgtgttgagtctacaacctgtgccccatgaaatccacattgttttgatagtgtttgaattagccatattctattttcagcagttaataagtctgttctttctagggcttcaatcaattcatttaaatcaactcgtttcatcctcgcggccttgattattccttcattaatatcatttacataaccaccttccactctcctattgataacccaggcaaaaaaatttactgtattccttaaatccggtgaatcatgatgacatttatgacataataaaaatagattggaagcatcatcatttccaccaaattgtcttgccacgatgtggcaacgttccaattggcttctgttccaaacatcactaatagtccttgatgctattaattcttgatttaccactggttttccacacgcccaacactccggctcgccccaatctgcaacaactatttccacttcattaaaatccgttgtttctgttaaggtgactatttcaaaagtctttatattaatccctttatcaaaccaatattttgctattttgcttcttgaaatcaccgtatttcctcactactttcagaattataatatattaaattcagtttactatatctaagacaacacatccataacaaaaaccattttccagttttaagtaagctaatgacaaacttttgctcctgagtatcggttttgccccgtggtatcattttactgaaaaccccatagcaaaaccctctatgaatatttaccccaccttgcctctgtggaaacttatccatctcactttccgcaaaaacacaactacatttttatcaaataatcccgcaaacccgcatagaatcaaccttttcgcacgagcaacacgacagtttcaacatgctccgtccaagcaaacatatcataaggcacagctctcactgcctcataccccttcttaaccaaatacctcaaatctcttgccagtgtctccggattacaggaaatgtacaccaccttctttggtcccagcttcactacagatgacagaaaagcctcatcactgccagccctgggcgggtccataaaaaccacatctgccttttctccctccgcggccatctgcaccataaaggctccggcatccccctgaaaagccctgaaatttttactgccgtttctctttgcattgatacctgcatcacgcaccgcatctttatttaattccacgccgatcacttcctttgcgtgttttgcggcgatcaggccaatggtcccgataccgcagtatgcgtcgatcacccgctcttttcctgtcagccctgcaaattctactgcctttccatacagcttttctgtctgtacaggattcacctggtagaaagaggagggtgagattcggaaagtacagccgcacagctcatcctcgatatatccctttccgtaaatggtaatgttcctttcccccagcaccatgctcgtcctcttgtcatttacattcaggatcaccgttgtgatctcaggatgcagttttctcagtgccttcacaaaattattctttgatgggaaaataggcgaaacggctactaagactaccatgatctcgccgcttgcaaatcccctgcgcaccataacgtgccgaagaagcccatatccgctgtcctcgctgtaaatcttaatcttaaaagacttcaaaagtcctcggatgtcctttacaataacatctgctttctcatcttctatgagacagtcatccacaggcaccaccctgtgtgttccctctgcatactttccggaaaccgcacttccgtcgcggagatgggcaaaagaagcgtgtactttattcctgtaatgataaggattctccatgcccacgatgggctccactttacaaattccttttaagagcttccttacctgcttttccttgccttctagatgctccttatatgaaacacctctgcagctgcatcctccgcatttcttgaccacaggacatttttttatttccattttgttttccatatataacaacctttctatctgctctcttctgaaacatcatttcacacctaaacagcatttcacacccaaacagcgtttcacacctaaacagcgtttcacacctaaacagcgtttcacacctatgccgcctttcatttattatatccggtaaacctgtccgcgtccataaaaagaacagagaaccttcctattacaatgaaacaacggcagattcctccgtaacacgaaggcctctgccgccaccttattcctctttttccaactgccgtatcaaataccgccccaccacttttgaaaatccatttacattatggatataggcaaaatcttttccgaaaattttcttctccgccggcagatctttctcctccccggcaaatacaccgagaacgcacaccccctggtttctcagtcttctcacctcaaaagccgtatctgatatggcgtatttcccttgataaggctgtggattcctggcattgggccggttcagtatcacatcatagggacgcccgtcacttaatacgatcagaaccttatgttcctcatcccgattcagcagttcatgacctgcggctttcagggcaagtccatccctgttgttagaggatgtgatatattcaaagatattattgtttgcgcttctgtcatcctcataaccgcgaaaacggtgcatgatcgtataatcccagaaagtacaaaagctcatcaccctgtggggtatattcacattactcagcgcctcactcaaaatataagcctgcatagcaacctgcccctgtctgctcctctgtgacccgctggcatctataagcacatccaccacaaagtcactgttgtcctgcttcagctcccggacaaagatttttgcgtcatttgtcctacttaccctccacagccgggagggaatgatcttccccctgtccgacagcacttcatccgtctcatcacgcatagtaaaggcctttttcagcatatctgtcagcgtccagatattatttttcaccattctgtgattgttatggtaagcgtataaattcttgtctttctgttttttggcatattcatactgataattgcgaagtaccggattctttaaaacgccctctgtgaaatacaggctgcagtccccgtgaattcccctgcacaataaataattcagacgtttttcctcgggttctgtcagataagtctttccataatttctctgtacatagctgtacatacgctccagagccttttcatccactaccagcacctttttcctgttggcagtctcctcttctccgtcctcttctttctcctgttgcttttcctgttccatcatatccaggttggtcatgctctctgtcaccttgtcaagataggcagaaaaggtttcctccagagcctcctcatccagataatccttccaggagaactctgtcagttcctccagagtaaccgccagtacacgctccagggaaccatgctgcttttcaaactgcggatccacgatctcattataaagaaaatccacagtccgtatgacttccatggtatctgcggcatgtttcagctcatacaccctctccatgaacccccgcagtctgtcagtggccggctcttctccgttcaatgcctccttgaaaagtgatatttttaaccggcctgcctcatatcctaccaattgggaaaaatccagctccaaggtatcctcaaaagcttttctcctgatctcccctacaccttctctttccgccatgatccggtcacagactgcccactcaatacaaagctgcgcaaggctgatcagttccccctctgaagcatggaggtatatcttcttgaccagatacagggaaagctcctcccggtcaaaataacgggcaaaagccccctgtttgatgccgtcatagagagcaatatacctggaacggcgaaagctctcaagatccggtttcacatccagtgtataatccccgcttactgtccacatcaggttgcggatcctgttttccagctccagctcaaattcttctctcattgaaatacatcccctgtagtccaggattccggaattcttgtcatgaccacatcctgaacgatctctttttcaaacacatcaaaacacttgttgaccacacccatacggacagctagagccggagaaagcccacaggaaactgccttcaaggctcccagcattccacgcaggtcaagggattttgtggtaatctcgctgtttcctgcctttgtctgcaggtccatgaaaagcccgatccactgtctcagagcgttttcttttatctccgggaattttctccggaatatatactccagggtctcctcgttctgcggcggcatgtcaatcacaaggaaacgggaaaccaaagcctcattcagttcttttgtgcccgcatacccgtaattcatcgttccgataaaccgcgccgcgtcgtgcagatcgatcttatcatatcccggcacgtcaatgcagcgcctgtaatccagggaggcatgaagaacagaaaccgcatcattcttcgccatattgatttcatccagaactccaaaaccgccgaactctgcgcaccggtatatactgcctttgcgcagttccacctcgttattgacaaatgtgtctgtaccgatcagatcaccgctgttggtatttacatggaaagaaacattgtataccggccggccgaagatccaggccagattctccgccagcatatttttccctgtagctttagggcctgtcagaagcaggttctccccttccaaaagggccgcgattcccatttccagaacttctctgccataaaacggcatatccggacagatgacacgccctttagcctcctccgccacatcatattttgaccggaattcctctactccgtcaataagtccgctgtccacaccctgttcccgtaaaaattccaattctttctccatatccaattcctctcacctgtttatacttctcttactctacatcagagtaatgataaaatacattctaactgttacagcacccgcacagttaccatcaaaaatccatgctgaatcatctcttgtgatagattttgcccggctgctgaatattatcttatggtcagcactgttcgtgcgcagacctattgaatcatttcaatgtgtcatataaactataaaactcataccttttctgaatcctaccataccacatcgtttacagtctgttgcagatgcaacaccacttttattattataacacaaaaggtgttccgaatctgcgtccggaacacctttttctgtttcatttataatactttctgattgtacaggcaagtctgcacatttgcttaacccttacttaactgccaggtgccggaaacatatgaactatagaatacatatccatggcggaatggccctttacaaaatatttccttgcaaaattatctcgccagaataactcgggcagatgggttcccgcaaatggaatctcgcaaatagattcccacagggaaatggttccggccaaatggattcccgcaaggatataatccccgctaatgggttcccgcaggtgtatagttcccgcctaatggattcccgcaaggatataatccccgctaatgggttcccgcaggtgtatagttcccgcctaatggattcccgcagggatatagtccccgctaatgagttcccgcaggtgtatagttcccgcctaatggattcccgcagggatataatccccgctaatgggttcccgcagatgtataattcccggcaaatagttccggcattcattctactctgtaagtatgcaaatataacagactacattttatgccatttgtctttatacatcaaacaataagtccccgtaagaaggcattggccaaatttctttgtccacgatcatttccaattcatccacagggcggcggagggcttccattgcaggcattaccttttcacggtaaaagaaggcacgctcttttccctcctccatatctgccgctgtctttgccacatcttttaagtgattcagcgcatccctggtatccttcagaagagcggatgtatctctgagcaattctgtctgcacatccacatccagaatacctgctgatactactgcattgacagaatccgccagattctttgtatatttaatgactgcgggtatgatctgcttgctggcaacatctatcatagtccttgcctcaatattgatagccttggaataagtctcgtatttaatctcttttctggattccagctctgctcttgtaaacacgccgaactcctcaaaaagactcacagactcttcataagtcagggcttccacggcttccaccatacatccgatattgggaagtcctctctttgctgcctcttccacccattcctcagaatatccgttgccgttaaatacaatcctctggtgctttgtaaaattcttcttgatcaggtcatggaccgccatatcaaagtcttccgccttctccagcacatcgcaggcttccttaaaggactgggcaacaatggtattcaggaccatattggcaggagcaatagaatcccttgccccaaccatacggaattcaaacttattgcctgtgaaggcaaacggtgaagtcctgttcctgtcagtggtatcacgcataaactcaggaatagatttgacgcccgtctccagcatctcgctctcaatgctgtggtcagccatacctgttgtgatcaactggttcataacatctgtgagctgatctcccaagaatacagagataatagcaggaggagcctcattcgctcccagacgatggtcatttcccacatctgccgcagattcccgaagcagcgcggcgtgtctatccacagccttcagcacacagcttaaaaccagcaggaattggatattctgatggggtgtgatacccggatcaagcagattcactcctgtatctgtagtcagggaccagttgttgtgcttgccggaaccatttacacctgcaaacggcttttcatggagcaggcatttcatcccgtgctgagaagctattcgcttcagggtctgcataatgatctggttatggtcagcctccacgttgacttccgcatagataggcgccaattcatgctgtgcaggagccgcttcgttatgctgtgtcttggaagtaacccccagtttccacagttcctcattcacgtgcttcatatatgcagatattttctgacggatggttcccaggtaatggtcatccatctcctgacccttaggaggcatagcaccgaagagagtacgtcctgtaaaggtcagatccttcctctgcataaagtttttatcactcaccagaaaatactcctgctccgctcccacggaaggggtaactttcttggcagttgtatcgccaaaaaggcgaatcaggcgcaacgcctgtttattgatagcctgcatagaacgcagcagtggggtcttctgatcgagcgcttcccctgtataggaacaaaatgccgtaggaatacagagtgtggcacctgccgcatcatgccttacaaaagccggagaggtacagtcccataccgtatatcccctggcctcaaaggtagcgcgcagtcctccggacgggaaagaagacgcatccggttcgcctttgatcagctcttttccggaaaaactcataagaacttttccactgggcagcggtgctgtaataaaagaatcatgcttctcagcagttacgcctgtcagcggctgaaaccagtgagtataatgtgttgcccctttttcaatcgcccattccttcatctcatgggcaatcacatctgccatctcaggagacagttcttttccctccaggattgcatgtttcaaatccttgtaaacctttttcggaagacgctgctgcatgacggtgtcgttaaacacgtcctctccaaaaatttcagatacatttgtatactcgctcatatgtttttcctttccttactgtgctgccccatactacatctctcccaggccccatatcattctcttgacaaaccacacgtccccgcacctgagaaccacggagacctctggtcattgaaactgtttctaagatacctcaaaaaccgctaaaaatcaagaaaaaatttacaatttaccctctcagagagccaattgccagcaaaagaaggcacactccactgagccaggacaaatcccggttcaatatatgcctggttccatgccccagcatccatcctgcctccatgaccgctataccggccaaaaaagagcctatgaccagcatcacctgcccggactgtaccagaccggtaccaatacccacagctatactgtcaagagacaatataaaagcaagccccagtccctccagcagattcagtgcctttactttctctgactcttcttcccctttctttaaaaaataggagaaaagcctgtaacatccaattccaaacagcaggagaaatccaagtctccccgtaaccccttccggaagcagcgccgccagacggccccccataaaaatcgcagtacctaaaatagtgctcatcagcaggttcatacacactacaatgccaaacggcatcttagttttactaactccataagcaaaactgaccacgaaagaatccatggtcagtgcaagaatcaacaatataccctttaaaacagctagataattcattgcacacctgattagtttctgtttctattatagtattccggtgtgtgcagaagtggtatccctatgacagtgtattgattttacagatgcgatgtctctatgacaacgtattggtttgtgcagatgcaatatccttatggcaacgtattagtttgtacagatgcggtatccttatggcaacatattagtttgtacagatgcgatatccttatggcaacatattagtttttacagatgcggtatccttattccagcgtattggtttgtgcagaggcaccatcgccatgactattccacgtattggtttttactgatgcgccatgactattccgccatgttgatttttactgatgcgccatggctattctaccatattggtttttactgatacgctattccctattcctactttttggtttgtaccgaagttccatccttattccagcgtattgatgagaggaaccgtatcatcctccgcgatcatgatctgtaccgcatgcttcatatttgtaatttccacatccctgtgctctcctccaaactccccgtccagagtccaggaaacagggcctacacaggaaattctaagtgaagacgttttgaaagattcaatcagtttcgtatccgccccaccaagcatggaggcaatgatctcattcagctccaatatatttttaggcctgtgcaccagcataacttcaaatactccgtcatccagcataacatccgggcctgtcaatttccggaatcccccaacagaggttgcattgctcaccatcccaaagataaactccccctccatggtacattccaggctctccacagtcatattgtaagatttaatattaaacagtctctgggttccttccaatatataagcagcatgacccaagatattcttcaaatcctggttcgtctcataagaaacatctgtaaacaatccaaaggccgcaatataaacgaaaaagtcatcattaaacttccccacgtcaaaagcatgcgcccttccctccacaatgtccacagacgcctccagcatatttttagatacatgcaaactattggcaaagtcattggtactccccgcaggaatatagcctataggtgtggagtgtcctccctccatgatcccggtgacgatctcatccagggtcccgtctccaccgctggtaaccaacaggtcatattctccgcccttacgcctggcaaccctctgaccatccctgtaagcctgcgtaggatgcacagtcacctcataacccgccttcacaaatatatcaagaatatccaccaaccggttcttaatactccccttcccggccctaggattaaaaataaacaacatcctcttacccataactgatcctcccttttcatcttcagattattttactaccgaacccccaattatacaaccacatttcccctccctttattctaaaccttttattttccttctattttttcttttattctttcttttcttttttctttttatctttttatcccctttttcccgcatgacactctcaggggaacccgtggcagggagcagccctgtggtatcctgtgagcggtgtttcacggagcgcctgggagatccacctgcctcagacgcttaatgaggaagcccttgctgacgaatttagcgactgagagcaggttagctccctggcaagcgcagtgcaccgttcacaggataccacagggctgttccctgccacgggttccccgtccccctcatacaaaaaaaggcccccaggttcccccagaggcccaataaccacatattaaactaactctaaaacaacttccatagcagcgtcgcccttacgcggtccgattttgatgattcttgtataaccaccattacggtcaacgtatttcggagcgatttcagtaaacatcttgtctaccatgtccacttctttggtgtttttctttcttccggcagctgcaacaggaacttccttgattggatagaacactttcagcatctgtcttctggcatgtaatctggaagcagagtcttttttgatctctttttccacttcgtcatatacggtaactttcttaccatcaacaacttcttttactctctttccgtcagcatctttgcgcggaacttttgccataactttaactgtctcgaagttatctttttcttttactgccatagcaattaagccttcagcaattttgcggacttcttttgctctggtctcagtggtaacgatttttccgtgatataacagatttgtcacctgatttctcagtaatgcttttctctggtcagatgttctgcctaactttctatattttgccatctcaatatttcctccatttgtggaacaatatgccatgcttcttcggtcttactgacatactgctttttgcccataaattcctatcagagacttactcctcgctgggatttaactgtaagcctaattctttcagcttcgcaagcacttcttccagagatttgcgtcccaggttacggactttcatcatatcctctgaagtacggttgcaaagttcttctactgtattgataccagcacgttttaagcagttgtaggaacgaacggataattcaagttcatcgatattcatctccagaactttttctttctcgtcatcttccttctcgatcatgacttctgcagtctttgcactttcagaaaggtcaataaagaggcttaaatgctcgctcagtactttagccgcaaggctgactgcctcatcggcgtccagggtaccattggtgtaaatatccagtgtcagtttatcaaagtcagtaacctgaccaacacgggtattctcaacagtcatgttcacacgctctaccggagtatagattgcatcaactgcaatctcaccaatcggcatatcgtctgtttttcctttgtcagcgctgacatatccgcgacccttggtaattgtcagttctgcattgaatttgcatcctgtgccgccgtttaaggtggcaattacctgttctgggttcaggacttcgatatcctggtctacctggatatctgcgcctgtgacaacaccttcgccttcaaactcgatataagctgtcttgggttctgtgctgtcgcttgtgttcttgattgccaggtttttcagattcatgatgatctgtgtcacatcctctttcacacctggaatagaactgaattcgtgcagaacgccgtcaatcttgacctggctcactgcggcacccggtaaagaagaaagcatgattcttctcaaagagttgccaagagtaataccatatcctcgctccagtggttccacaacgaatttcccatatctcttatcatcagacatttctgtgatttgaattttgggtttgttaaaatcgaacatgcaaagccctccttgctacgtgcatattacttagaatacaactcgacgatcaacatctcatcaacaggaacgtcgatttcctctcttgtcggaagtgcttttacttcacctttcagattttcctggtcaacatctaaccaacccggaacaagacgtccgcctgttgcttccagtacgtctttatatctctgagaagatttgcatttttctttgatttcgattgtatctccggcttttaccaggtaagacggaatgtttacctgtttgccgtttaccattacatgtttatggtcaacgatctgtcttgcttctcttctggttcttgcgaatcccatacggaagataacattgtccagacgtgtttccagcatgatcatcaggttttcacctgtctggccctgtttctggtcagcctttacgtagtagttacggaaaggtttctccagaacgccgtagatgaatttagctttctgtttttctcttaactgaagtccgtactcagacatttttctgtttgctcttcttaactgtctggtggatttcttgtcaatacccatatatacaggatccagacccagggatctgcatcttttcagaactggtactctatttactgccatgatttcttaacctcctaattaaactcttctgcgttttggtgggcgacatccgttgtgaggtaccggtgttacatctttgatgcttgtaacttccagaccagctgctgataaagcacgaattgctgcttctcttcctgatcccggtccttttaccataacgtccactgtttttaaaccgtgtaccaatgctgcttttgttgctgtctcagcagccatctgtgccgcataaggagtagatttccttgaacctttaaatcccagaccaccggcacttgcccatgataaagcatttccttcagcatctgtcaatgttacgatcgtattgttgaaagatgactggatatgtgcctgtccgcgttcaacgtttttcttaatacgcttttttgtcactttttttgtaactttagccatttttaaactaacctactttctcacttaatcaaatattatcatgtttcttatatcaaccacagaaagcacacattgtgtactttccattgttataaattatttcttcttgttagcaacagttctcttcgggccttttctggttcttgcatttgtcttagtcttctgtccacgaaccggaagtccttttctgtgacggattcctctgtagcatccgatttcctgtaatctcttgatgttcagagcgatttctcttctcagatcaccttctacagcgatattcagttcatcgattgcatcacggatttttcctacttcttcgtcagttaaatccctgcagcgagtgtcagggtttacacctgcctctactaagatacggtcagcgcttgttctaccaattccgtagatataagtcagaccaatttcaacacgtttttctcttggtaagtctacaccagctatacgagccatgtacttgttcctccattgttcttaataaatattgttcctaattgggatacataaaaatgacgggtctctatgcatccagccgcaaaataaaattttacgcagcctttccgtcacggcagagcgacggtattaagcaatattctgcaatcgccctctcggcaggacgacaaacgtgatatattactatatttgatcagtatgaacaacgcaaccttgcgttttatactgcagccgcactaaaatattacacaaatctcatcaactatcaaacactcactcaaatatcatgcccaacaaacaggcagtccaaaagagtcccatgcttaaccctgacgctgtttgtgtttcgggttttcacagataattctgatactgccttttctcttgataactttgcatttttcgcaaatcggttttacagatgatcttaccttcacggataaccctcctttctggatttctctgcacatgggcataaaaagtccacgtacgagcacaaaagtacgtttttaatgataacactctttttacaagaacgcaagcactttttttaattttaaccccattttctcaccctattcacacctaaaagattttctcccaaaaaatctcccccaaaaccctttccttctatacctattccccctaaccacacatcccccttactccagaatatcagcatccctctacactatcgcatctgaaaatatcaacagccatcccatactttctcctccgaaaatcgcgacacccatctcattctttctcttcccaaaattgcgacagccatctcattccttcttctccgataattacagcagccatctcattctttcttctccgagaattacaacagccatctcattctttcttctccgataattacagcagccatctcattctttcttctccgagaattacagcagccatctcattctttcttctccgagaattacggcagccatctcattctttcttctccgagaattatagcagccatctcattctttcttctccgaaaatcacagtatccattttatattttctctaccataaattacagcaagcatctcattctttctcttccaataattacagcagccatctctttttttctcttccaaaaatcccagcagtcatctcaaaccatcgcatctgagaacaccaggggaggccgtaggaggcaggggcgggagagggaatgggatgagcggcgtttcacggagcgtctgggagatccacctgccccaatcacttaatgaagaagccactgctgatgaatttagtgaatgggagcaggttagctccctgacaagcgcagtgcgccgctcatcccattccctctcccgcccctgtctcctacggtctccccgtccgccttcatcctcccgcatctgcactcatccatcccctatataaaaaaagcggagacaccccctccctaaagaagcccgcatctccactccatttcccaattcaggaactattttctacttgtctctccagataatcctgcccttactcaaatcatacggtgacatctcgatcgtaaccttatcacccggaagaatcctgataaaattcatcctcagtttcccgctgatatgcgccagaattacatgcttattctccagttccaccttaaacatagcgtttggcaacttttcaagcactgttccttctacttcaataacgtctgcctttgacataaatcaaacctcctgtttgcttctatattcttttatcactcttttgatagtttcatttttcagttctccaccctcactgagtattccctcaatgaccggggagattctgcggttaatctggacatgcctcaatttcttcttcttgggatgctcacaagtcctaagcgttccgtcagccagatagacatatccgtccaccgctctgacgatgatataatatctgccggtatcatggccagccatggaaagggctgccattcctgctctcacctcgctcatagggtcacctactcactcaaggtcagtatttccggctcgccgtctgtgatgagaatggtattttcataatgcgctgacagggatccgtcctctgtcaccactgtccagtcatcatccagccaaaccacatcggctctgccttcattaatcatcggttcaatcgcaagagtcatacctgcctgaagtctcagtcctctgcgcttttgacggaaattcggtatctgcgggtcctcatgcaggcttgtgccgattccatgtccgaccaaatccctgactacaccgtatccgaacttctcagcatatgcgccgatggctgcggagatttcatataaatgctgtcctgccctggcatacttgattccttcaaagaaactcagtctggtcacatcaatgagcttctgcgcctcgggtgcgatttcacccaccgcatgcgtacgcgccgcgtctgagtggtatcctttgtagatcaatccggcgtccagactcacaatatccccatcctggagtatgtgatccttacgcggaatcccgtgtactacctcatcattgacagagacacagatggatgccggatatccgttatagttgaggaaattcgggatacagcccatctgacggatgagtttctctccatactggtcaatgtcgagggtggaaatacccggtcggataaaatccttcagctcgtcgtgtaccttttccagaagctttccagcctctctcataagttcaatttcattggcagtttttatcgatactgacattttttacgctcctaatattttgacgattgcctggaacacatcttccatatcaacggttccgtcaacctgttttaatacaccggacttggtatagtagtcgatcaggggctgtgtctggtcatgatatactgtgagacgttttaaaacagtctccggcttatcatcatctctcaggatcaatttttcaccgcagatatcacatacatcctctttttttggaggattgtatttgatgtggtaagtagcgccgcatcctacgcacgctcttctgcctgacatacggttcacaatgttctcatccggaacatccacgtcaatggcataatccactttctgacccattttagccagcgctgcgtccagactctcagcctggggaattgttctggggaaaccatccagcacgtaaccattttcacagtcatcctgtgccactctgtccactaccaggtccactaccagttcatcaggaaccagcagtccctgatccataaatgtttttgcctttttacccagttctgttccgttcttgatgtttgcacggaagatatcccctgtggagatatgcggaacctgatacttatcggcaatcttcttggcctgtgttccttttcctgcgcccggtgcgcctaacataataatcttcatacttctcttcccctttcgtatttcaatccgcattccgccttaaaatataatcgcgggatgatatgcccacggattgctgcccagcccccattaaggctatgtccttatatagcattttagtgcacccacaaaagtgggtacacttaaatcatatatgcttattcacttaaaaatcccttatagttacgaaccagcatacgggactcaacctgcttgattgtctccaggacaacgcccaccacaatgatgatggatgtaccgccgaaggaaacatttgcaccgaatacgccattaaagaagaatggaataacggcaacaattaccaggcctgtggcaccgatgaagataatgtaacttaaaattttctccagatattcctgtgtcggtttacccggacggataccgggaatgaaaccgccctgttttttcatgttatccgcaacttccatcggattgaaggtgatggatgtatagaaataagcaaagaaaatgacaagcacgatataaacaaccagaccaatagaataaacaggttcattggggttgaaccagttacttgaagtcagaccttttaaaatcttgctcccgattcctgtaccgccgcccttgcccaggaagctcgcgataactaccgggaaagacataagggaggatgcaaagataatggggataacgccggcagtgtttaccttcaaaggaatcgcactggactgtccgcccatcatttttcttcctaccattttcttggaatactggaccggaatcttccgttctccaccgttcaggataagtaccagtaccactaccactataatgatagccataataatgatagctgccaggccgcctctggcgattgttttcccttttacgaacttctcgaacagggatgcaagatcgctggggattctggatacaatgttgatcatcaggacaatagaaataccattgcccacacctttttccgtgatctgctcaccaatccacatcagcattgcagaaccgccggtcaatgttaccacagcaactacaatactggtgaaattcatctctgtcagccagccgcggttaccaaagccgataaccatagctacagactggaagagagccagacctacagtcagataacgagtgatggcagtcattttctttctgccctcttcgccgtcacgctgcatttcttccaattttggaatcgcaattgtcagaagctgaatgatgatagatgatgtgatatacggtgtaatactcaacgcaaagatagacatctgttcaaatgaaccgcctgtaaatgcattgaagaaattgaacgcatcgttagactggcttgcaaacaggttcttaaagaagtctctgtctacgcccggaattggcagttgagagccaatccggacaataaccagcattaacaatacataataaattcgacgtcttacatcttttattttaaaagcgttcctaagagtctcaagcattaaatcacctcgactgttccacctgcagcttcgattttagttttagcggtttcgcttacagcattaacctttaagttgatcttctttgtgatttcaccgtttccgagaattttaacgccgtctccaagacgggaaatagctccggatgccagtaaagctgccggtgttacctctgctccatcctcgaatctgtttaactcgctgacattgatcgctacgatgtctttggagtttctgcatttgaagcctctctttggaatacgtctgtataaaggcatctgtccgccttcaaatcccggtcttactccgccgccggaacgggctttctgtcctttatgtcctttacctgcagtttttccatttcctgaaccatgtccgcgacctcttctgaaattgtcgctgtgtctggagccttcagctggttttaaatttgataaatccatgactgcacctccttcttcaatgattagatttcttctactttcactaagtgtcttacctggcgaaccataccgcgaacggctgcattgtcaggcatttccactgtcttgttcagttttctcaaacctaaagcttctactgtttttctgtttttcggaacagctccgattgtagatttcaccagagtgattcttaatttatctgccattttttaatcctcctacgcaaaaatctcgtcaacagattttccacgaagttttgctacttcttccggagtctttaactgacttaaacctgcgatggtagccagaactacgttctgtttgttacgggaacccatacattttgtacggatgtttttgatacctgcaagctcgatcaccgcacgggccgggccgccggcaattacaccggtaccttccggagctttcttcatcagcatctctgcgcttccgaattttccgatgaagtcatgtgtaatacttccgttatcgtctcttgctactgttacaagtttcttcatagcatcctcttttcccttgcggatagcttcgggaatttcggctgcctttcctaatccagcgcctacgtgaccattgccgtcacctacaacaactaaagctgtgaaacggaagttacgaccacctttaacaacctttgttacacgcttgattgacactactttttcttctaattctaactgactagcatcaatgatagaacgtttcatgtgttcatttcctcccttattagaattctaacccagcttcacgtgctgcgtctgccaatgcctgaacttttccgtgatatataaagccgcctctatcaaagacaacctctttgatgcctgcttcgatagctttcttaccgatgacagtacctaaatatgctgcagcatcaacgttattggttttttctaattcagcttttacctctttctgagtggtagaagcagaaaccagagtttttccaactgtatcgtcaataatttgagcatacatatgattattgctgcggaaaactgctaaacgtggagttgtagcggtgccgctcagatgattacgtaatcttctatgtttttttgcgcgaactttcgctcttgatactttactaaccatttttacactctccttaattatttcttaccagtcttaccgactttacgtctgataacttcatcagcatatttaataccttttcctttgtaaggctcaggttttcttaattctctgatttccgcagcgtactgtccaactttttctttatcaatacctttaacgacgatcttattaccgtctacagaagattccagtccttctggatcttccatctctaccggatgtgaatatcctaaggagagaaccagttttttaccctgttttgcagctttataacccacaccgtttacttccagagttttttcatatccctggcttacaccgatcaccatgttctggatcagtgttcttgttaaaccgtgtaaagatttcattttctttaaatcgtttggtcttgtaacaactacctgaccatcctctaatttgattgacatctctgtcggtaacgctttttcaagtgttccttttgcgccttttacggtcacaaaattgttctcagcaattttaacttctacgcctgccggaacagctactggctgtcttccaatacgtgacatacctgttgtcctccttacttaaattttcggaaaggcctattatggttcctttctgttttcagtatctctatctatgaaaattgcatatgtccggccaaagccgggaggcaattaccatacgaatgctaatacctcgccgccaacgtgcagctttcttgcttctttatctgtgataacaccctgatttgtggacaggatagcaatacccagtccgcccagaactctggggatttcctggctgcctgcgtatacacgtaagcccggtttggagattcttttcagacctgtgatgattttttcactcttgtctgcaccgtattttaaggtgatacggattgttttaaatgcgccgtcttcaagaacgtcgtattttgcgatataaccttctttaacaaggatatcggcaatagcaagtttcattttagatgccggaacatcaacggtatcatgtttcgcagtgtttgcattacggattcttgtaagcatatctgcaatcggatcgctcattgtcattggagtttcctccttctattctttatcccatatccgcagcagcggatgaactgattaaattgtttcaggcaatggattccagcacaccactctcactcacctcgtctgtcgccattggctcggactcactaagtcttcgggtgggctttctcactaaccccgtctgtcgccttcggctcggactcgctaagtgttcaatgcctaccaggatgctttcttaactcctggaatctgtcctttgtacgctaactcacggaagcagattctgcagattccgtattttctcaagtaagcatgtggacgtccacaaatcctacaacggctatattctcttgttgaaaacttctgttttctctgttgctttaatttcattgctgttttagccatgaattttccctcctataattactttgcaaatggcatgttaaataatgtcaataattcacgggcttcttcgtctgtcttagcagttgtaacgaaaatgatgtccatacctcttactttatcgactttatcgtattccacttcagggaaaattaactgctctttgataccgagtgcatagttgcctcttccatcgaatgcgttaggattaacgccgcggaagtcacgtactcgaggcagtgctaagttgataaggcgatcagcaaattcatacattttttcgcctctcagggttactttacaaccgatcggcatgccttcacggagtttgaagttagcaatggagtttttcgcttttgttgttacagctttctgacctgtgatcagttccatgtcagctacagctgcgtctaacaattttgcgttttcctttgcttcgcctacacccatgtttacaacgattttgtcgagtttcggcacttccatgatatttttataaccaaactttttgaccataccatctacgatctcatttttgtatacttctctcagtctgctcactttaaaatggcctcctctctaattaatcgattactttgcctgtagctttggcgaaacgcactttcttgtcgccttccatcttgaagccgactctggtagctttgccttcgtgtactaacataacgttagacacatccagccaagcttccttctctacaataccgccctgctgattagccatggaaggttttgtgtgctttgttaccatgtttgcgccttcaaccagaacagcaccttttttcggattaacagagattacttttccttctttgtctttatctttaccggcgatcactttaactgtatcaccttttttaatcttaaatgttgacatcaggttacctcctataatacttcgggagctaaggaaacaattttcataaactgtttctcacgaagctctctggctactggtccaaaaatacgggttcctctcggagtcttgtcatccttgataataactgcagcgttctcatcaaatctaatataagatccgtctttacggcgggcaccttttttcgtacgaacaacaacggctcttactacatcacctttttttacaacgccacctggtgttgcatctttgaccgtagctacaataatatcgccgatgttagcatatcttctagtggatccacctaacactctgatgcaaaggatttcttttgccccagtgttgtcagccactctaagtcttgactcctgttgaatcatgctgggattcctccttacgaactatttcgctttttcgactacttccacaagtctccatctcttgtccttagagagaggtcttgtttccataactttaacagtgtcaccgatattgcatgtgttttcttcatcatgcgcttttaatttatatgttctctttacgatttttttgtaaagaggatgtttaacgtggtcttcgatagctacaacgatagttttgtccatcttgttacttgtaacttttccaacacgtgtttttctaagatttctttccacggttatgcctcccttattactctgctgcatttgccttgttctgggcaatcagtgtctgaattctggcaatatttttacgaacctctttgattctgcttgtattgtccaattgattggttgcattctgaaatctcaaattgaagagttcctttttagcagctactaattcttcctgtaattctgcagctgattttgtttttaaatcttctacataatttttaattttcactgttatcaccgccttctaagtctgcacgagaaacgattttacatttacatggtaacttgtgcatagcaagacgcagcgcttcgcgtgctgtctcttctggcacacctgcgatttcaaacattactctgcctggttttacaactgctacccagtactctaagttacctttacctttacccattcgagtttcagcaggctgtgctgtcactggcttatcagggaaaatcttaatccaaaccttaccaccacgcttgatgtaacgggtcatagcgacacgggctgcctcgatctggttggatctgatccagcacggctcagttgaaactaaaccgtactcaccatagttgatcttatttcctcttaatgcttttcctttcatggatccgcggaattgtttacgacgtttaactcttttaggcattaacataattatttatcgctcccttccttagttcctttagttggaagtacttcgccattgtagatccatgcctttacgccaactttgccgtaggtggtatctgcttcagcgaaaccgtaatcgatatctgctcttaatgtctgcagcgggatatttccctcactgtagaactctgtacgtgccatatctgcaccgccaagacgtcctgatacagcagtcttgattccttttgctccggctctcatggttctctgcattgtagatttcatggcacgacggaaggaaatacggttctctaactgtaacgcgatgttttcagctactaactgagcatctttgtccggtctttttacttctttaatatcaacgatcagttttttgcttgtgtagttctgtaattcagctttcactttttcgatctctgaaccgcctttaccgataacaacgcccggttttgcagtatagatgatcactttcactctgtcagatgctctctcgatctcaatcttagaaacacctgcactgtataatttctttttcaggaatgtcctgatattataatcttctactaagttatcagcgaagtcgctctcagcgtaccatttggaatcccaatctttgataacgccgactctcagtccatgtgggttaactttctgtcccatgattgtcctccttatctctcatccaacacaacggtaacatggcagtttctcttctcgatcctgtaagctctgccctgtgctctcggtttgattctcttcatagtcggagctttgtttgcgtagcactcagcgatataaaggttttccgggttcataccattgttgttttcagcatttgcgattgctgattccagtaattttttgatcacgcttgacgcgtatcttgggttgtatgtcaggataccaagggcagtctgaacgtcttttccacgaattacatccagtacatagcatgctttctgtacggacattctagcgtaggatatcttcgcagacggtcttgtatctttattagcatttcttgctcttttaatctgacttctatgtcctttagccatgataaaagcctccttctaaaatattaacgaacacctgattttttctcgtctttgccatgtcctctgtaggttctggtcgcaacaaactccccgagtttgtgtccaaccatatcttctgttatatatacaggcacatgcttccttccgtcatgtacggcaattgtatgccctacaaaggatgggaagattgtggaacggcgggaccatgtcttgataactgttttatttccagccgcattcagagcgtctacttttttcagtaagctttcatctgcgaacggtcctttttttaatgaacgagccatttagccttacctccttatttcgctaatgttttaccatctcttcttcttacgatatacttgttagactgtttgtgtttcttgcgtgtcttcaaaccaagtgccggtttaccccaaggtgtacatggacccggacggccgataccagtcttaccttcaccaccaccgtgcggatggtcattagggttcataacagaaccgcggactgtaggacggaatcccatatggcgtttacgtcccgctttaccgatattaataaggctgtgctcgccgttacctactacgccgatagaagcgcggcagttgatcggaaccattctcatttcacctgacggcagacgaagggttgcgtatttaccttcttttgccattaactgtgcaccgtttccagcggaacgaactaactggccgcctttgcccggatacagctcaatgttgtgtatcatagtaccaaccggaatctctgacagaggcaggcagttgcctacacgaacctcagcgttagcgccgttctggatcttcataccaacctttaatccttccggagcaaggatataagctttctcaccgtctgcatatgtgagcagtgcaatgtttgctgttctgttcggatcatattcgatagctgttactgttgccggaataccatcttttcttctcttgaagtcgataattctatattttcttctgactccgcctccgcggtgtcttactgtaattttaccctgattattacgtccagcgtttttatttaaggacactaccagagacttctcaggtgtcgctgttgtgatttcagagaaatcagaacctgtcatgtgtcttctggaaggtgtatatggactataggatttaattcccatttctgtctctcctttcattctccacgccgcaggcgttgtgttcacaacgcatcctggcgttttcatgccggcagtcaaatatcggattaatttttcttgactgcgcttagttactattggttaagggctgattaaagtccctcgaagatttcgatatctttgctgtcctctgttaaagtaacaacagctttttttgtctttgctgttttgccgaaggtcacaccgcgtctttttgtcttgccatctaaattcatggtgttgacagttttcacttttgctccgtcgaacattttttcaacagcttctttgatcatggtcttgtttgcttccggatgaactaagaaagtatatttcttctcgcccatagcagccatgctcttctcggtaataaccggtttcaggattacatcataatactgtacgtttgccattatgcgtatacctcctcaattgaagctacagcagattttgtcaggattaccgtattatatttcagaacatcatatacattaatggtgttcggtaatgctgtgatcacattcgggatgtttcttgcggataatactacgttctgatcattgtcagccagtactaccatagctttggaaacattcaggttgtttaaaactgcctgcattgccttggtttttgcttcatctaatttcaggtcatcaagaacgatgagcttgttctcctgtactctgcttgtcagagcggacttaagagcaagtcttctttcttttttgttcattttgatctcataatctctcggaaccggagcaaatacaactcctccgcctgtccactgcggagctctgatagatccctgtcttgcatgaccggtacctttctgtctccagggttttcttccgccgccgcgtacttctgaacgtgtcttcgcgctctgtgtaccctgacggttatttgctaactggcttacaactgccaaatgcactaaatgctcgttgatctcaacgccaaaaactgcatcgtttaattccattgttccaacttctttgccttccatattataaacagatacgtttgccatctgtgtggtcctcctttcccagaaaaactttatttcacggttttaacagattctttgattgtaactaaggatttcttcggtcccggaacgcttccttttactaaaagaagattgttgtcagtatcaaccttaacaatttccaggttctgaactgttacttttacatgtcccatctggcctggcatctttttgcctttgaataccttgctcggatcagatgctgcaccgttggaacctgcatgacgatggaatttggaaccgtgagccataggtcctctggactgtccgtgtctcttgatcgcgccctggaatcctttacctttgctgatcgcagtggcatcaatcttatcgcctgcctcaaaaacatcgcatttgatttcctgtcccattgccatttcttcggcactgtctaatttgaattctcttacaaatctcttgcaggaaacaccagctttgtcaaagtgtcctttcagtggtttgttgacaaggttttctctcttgtctgcgaaaccaacctgtactgcactgtagccatcgttatcctgtgtcttaacctgtgttactacacaaggaccagcctgcagcactgttacgggagttaaaactccgtcttcattgaagatttgagtcattccgactttggtagctaaaatcgctttcttcattttttctttacctcctgtgaatctacagcggattacactgcgttgtgcaatcatcctagacagacagtcaatatagactatatatcaaccttgtaaggataatttcatctcttaccggcaagcttgctgcgcatgccttatttctgtttcattttgatatcaatgtatacaccggccggcatctctaaacgagacagggcatcgactgtcttctgtgttggtgtgatgatgtcaatcaatctcttgtgagttctctgctcgaactgttctctggaatctttgtacttgtgtacggcacggatgatggtaactacttccttctttgtcggcatcggtaccggtccgctaacagttgctccattcttctttacagtctcgatgatcttgcttgcagatgcatctactaactgatgatcgtaagcttttaatgtgattctcattacctgacttgccataaaaaaagtctcctccttttcgcacttataagtagtacgacaagcggcgactgtacacattcccgtgtgtgtcatctaacgtttcacacactcccacatcctcgtggtaagtcttcaagatttcgtacagtgacttgtcgccagttttaacaacttgacattcgctccacggaaaacctgccatctcggcagcaacctcacgcttcacagctatcaatgtcacagcactagttagtatacaggatgtttttccagaatgcaaggtatttttttctttttttgaaaaaagtttgcattttttcccgtacacggtttttttctcctgaaaataacgaaatcagcggcacattcccgcttttggggagaatgcaccgctatactgctgtctttctttaccgatacctgttacttttcagcgttacttctcagccacccctgacgctctggcggcctctgccactgcagcggcgactactttggccactctgctgtcaaaaggattcggtataatatgatcaggtgttaaatccttctcctctatcagccctgcaatggcatatgcagccgcgatcttcatcctgtcattgatatctgacgcccgcacatccagagcgcctctgaatatgcccgggaatgccagaacattattgatctgattcggaaaatcacttcttccggttcccacaacagccgcccccgcttttttcgcaaggtcgggcatgatttccggtacaggattggccatcggaaagagaatggggtcttttgccatgcttttcaccatctcctctgtcacggttcccggtgctgatacgccgataaaaacatcggcatctttcagcatatccgcaagacttcccttccgcttctgccggttagagattttcgccatctcttccttctccgcgttcagtccgtccctgccctcatagatggctccgtttctgtcacacattaccacatccctgagtcccagactcacaagcagtttgataatggcaatgcctgctgcgcctgcgccggatgtgacaacacggacatctgccagttttttgcctgtcagcttcagggcattgagcatggctgccgccgtgaccacagcggtaccatgctgatcatcatggaaaacaggtatgtcacagcgctctttcagcttccgctcaatttcaaaacaccgtggcgcggaaatgtcctccagattgatccctccgaagctccccgccagcagagccacagtattaacgatctcatccacatccttgctccgtatgcaaaggggaaacgcatccacatccccaaactctttgaacagaacgcattttccttccataacaggcatccctgcctccggtccgatatctcccagtccaaggactgctgtcccgtctgtaaccacagccaccatattgctgcgcctcgtatatatataggaaagttctctgtcctctgcaatcttaaggcaaggctctgccaccccgggagtataggcaatagataaatcctccggggtctccagttttgccctgctcaccacttcaatctttccgtgccatttctcatgctgccgcagtgcctgttctttcttatccatatctctgcccccttctatccgatcacctgctctgtaaattctctcagaatgcctacagatttatccatatccgtcttttctttctcattcatgggaatacgcagcgtctgctcgatcccctcccatccgatcctgcacggaagagatacagcaacccctgaccacttatcaaagctctcatctaagacatgggctaccggaagtatggcatcatcatctttcataatggtctccacaatattggaaaccgccatagctatcccgtagaaggtagcacccttcagcttgatcacctccgcaccgccgtcctttgttctgcgggctatctcctcctcatccagtgtgatgccaacctgctgtgcataatcataaaggggaaatcccccaatgttggcagaactaaaaataggaacctgactgtcgccatgctcacccagaatataggcattgatatcctctacattaacatgcagcttctcacttaaaatatggcggaaccgggctgtatccagggatgttccgctgccgatgacacgtccggagggaagcccggactctttatacactgccgcggtagtcacatccgcggggttggacaccacgaggatcagtggattctctgcatacttcatgatattctgtgtaatgctctttacaatagaaacatttgtctttgcaaggtccagtcgtgtctggcccggtttcctggcaattcccgctgtgataatgatgatcttcgcatcagcgcactcctcatatccgccctttctgacccaaacctgtttaaaaaaactagtaccgtgggcaatatcaagagctgccccctcagcccggtcctcgtttaaatctaccagcacaatatcattggcctgcacacgtaccattaacgtataagctatagcttcacctacattgcctgcacctatcactacaattttgtctctatgggattctttcattttattcattctcctgtctgaaatgttattttctgtatgtgtctttataatctcctaaaatttcagacagacagcggaggcccccgcctcttccagaggtcatatctcctctcacgatcatccgcagcttccctgcagacactttccctcttaaagtacagccaaaaagccgcacacgcggcagccgcaggaatcccccaggataatataggggattttctcttttcctgcctgtgaaggctgtcctgggaacgttcttttgttatgcagtcatttttataatgaaaaacctgatgtccaacagaaacctcagtcttctcctccagtacatcccattgtggttttggctctgtatatgtccctagaatcccggaaaggactacggccagaatcaggaggagtttcaggatggttcctgttttctgttttatacttttcacttatgtgttttctccgctgtgattttttaaaaatacagtttcatcataatacagacgtttgattttttcaacactttattcggacagagaggggaaaagattttgtgaaaggcggacggaagatgacagagacaggccgggggaggggaaggactgtggacgaagcgttccgctgccacggagctaacctgctcccagttactaaattcatcggcaatggcctcttcattaagtaactggggcaggtggatctccgcggcgctccactaaaacatcgtccacagtccttcccctcccccggcccgcctccgtcctcttcctgttctccactaacccacaagattttgaatgtaaaaaagaccatctgctatggctggagtaattaatcatcaagtaagaaagaaaatctttatcaacatataaatatataaaatggagataccttatttttctatagctataagatgaaatactattattctacatatgaaacgggatgactttattcttttctacatacaaaataaaatgacctttcttctttccacgtacaaaatagaatgacctcattcctttccacattcaaaactgcataacctcattcctttccacactcaaaatagaataaccttatttttttctacatacaaaaaagagagccattgtttttcacctcccggagagaaaaccagggatggagggggaggctgcggttctcttttggcagacattgcgatagtgagcctgaaaatccagcccttacggagacttaggcgcgaagtctttactgagcgtcttagtcgaagttagggcttagttgaaggggaacgaagctggctgccaaaagagaaccgcagcctccccctccatcccgtccgccgtccgccttccacacaaaaaaaggacaacgcccaaccgtcatccttttcttacttcttacaacaatttagaataatccagaagtgtcacctcattatccttatcctcgatcacttccggtgactcccctgctgcttctgccttagaaagcagttcagtcacagacggggcagggagtacggcttccttgtccactacgggcacctcctcaggttcaggttcaatctcctcttcctgctgtacctcttcttcggcagccatttcttcctggggctgcacagcttcttcatccgctgtctcctggatagcagtgtcatcagatattatctccgctgcaggttcttcggaatccgcattttcctccaggccgaggataatctctgctgtcacctgaggtactgcagtttcctgtacctcctcaggcgcctctatctctccattctgtacctttgcaatgctctctgcaatagatgccatggcatctttcatagcgctgtcatattcatcaggctgctttgccggcgcgggggcaggttccaaaacgggagcttctgcctcatcatcctctgtctcttcttcatccgaaagaccctttttggcaagtttcctgcggcgcttttcctctttcttgaggcgcttacgctctttgcggctcagcttttcttcttcctcgtcttcgtcctcatcttcttcgctgtcatcctcgtccgaagcatcctcttcctcttcgtcctcttcttcgtcctcttcttcgtcatcgtctgcctcatccttacgccataactcagccaggataaacagtatgatcagaaagatcacgccaagtccgactacgatcagaccttctttgctctgcagggcaattgccgcatatgcaatgtagggaactaccacaacgaccttcactgcattattgatcaactggactgtttcctctttcgcattcttgtcgtacacacttttcaccttgtacgaaccagcggaagaatccatatcagtaactttatagacatatgccttattgttattggtataaataatcttatcgccttttttaagacttgcggcatctatctctcttccgtaagcaacagaacccaccggaagatttgtctctttactgctgttgtcgttcatgactgtgttgacccctgcaaagggaggaacaagcagggcggctgccacaagtattgcgcagatcacaaccagattcacaataaatttcaaaaacttagacatgtgtgtattcctcatttcgtaatctcgtgcttatttttgctgaagtccatgcatattttatattaacattttccggctgagatgtacataggaaatcgcaaaaattttaatccgcacgctctgtccctatggttctcagcagtttctgaggaatgcaagatatccctgataggcctcatagatgtccactttactggcaatttcccagggtgaatgcatattcagcacaggtacgccgcagtcaatgacctccatattatagttagccagtatgtaagcaatggttccgccgccgcccgcgtccaccttgcccagctctgctgtctggaaggatactttgttctcatccataacacggcgaagctgtgcaatgtactcagggttggcatcattggaaccgctctttcctctggaaccggtgtatttgttgaaggtgatcccatggcccagataggcggaattcttcttctccatcacctccggataattggggtcaaaagccgcactcacatctgaggagagcatcttggaatttttcaaagccctgcgcaccagcagttcactgtactgtccgcaggcattcataacctctgccactgtattctcgaagaagcgcgactgcatacccgtggcacccacactgccaatctcctctttgtccaccagaaggcatacggatgtatacttcaccttatccacagcagctatggcctggaaggagggatatgcacataccctgtcatcatggccgtatgccataagcatactacggtccagtccgaaatctcttgcggctcccgctggaaccacttccagttcagcggagataaagtcttcctcctctacctgatacttctcctttaatatagaaaggatctgtgcctttaccgcctccgtctctgttccttccaggggaatactgcccaccagcacgttcaggttctcaccctccacgacttcttttgcgttcttctccatctgttttcctgagagatggatcagcaggtctgagattcccacaaccgggtcgtctgcatcctcaccgatcacgatggggagcactgtgccgttctttttcaccaccacgccgtgcagggccatgggcagtgtcacccactgatatttcttcacacctccgtaatagtgtgtgtcaagcagcgcctgttccgcctcctcatagagcgggttctgtttcaggtcaagtctgggggaatccacatgtgctcccaaaatgcgcatccccttctccatgggttcttcccctattagaaaaagtgccagcgcttttcccatattgtcagcatataccttatcaccggctttgagttctgttcccgcattcacaacagcatccaagtttttgaatccggccttctcagctctcttcaccatctccgcaacacattcacgctctgtcttgcatccggatataaacttcctgtaatcctcgcagaaagcaaaaatttcacttttgtcttcgtatttcttccaagcgttttctgtcaattgattaaccacctttcctgtcgggcttctgcctttctcttattcaagattactacacagggaatggaaatgcaagattgaactgcgctttttaaagggctgtaaacaataacagaccggaaccccggaaagatgcacgctgctacgccatctgcccagatcccggcctgactgtttttcttcctatatataataggaacatcctctgcagctcatgactgccctgacaaggttaaaacctgagtttcaaagtcttgatctcaaatggcttcatcctgaaggatacctttcttccgtcaggcgtccattcatccatgtctgcttccagcatgtcacattcacatactgactttatatcctctgcaaatacaagggagacgtccgtccttctgttaaagcattcgtagagtctgacaatgacagcctcctcatcctccgcttttttcaccacctcaactacaacattatcctggctgcaggtgacaaaggagtaggcatccggcagtgtgccgccctcattctcctttactgccgcttccagaggattattcagcagatatgcctggttcacagtacctgcttccttccaactgccctgatgcgggaagatcgaataggtgaaagtatggtgttccttatctgcctcaggattgggataaactgctgatttcagcatggatataccgatcacgccatcccggacgctgcatccgtacttgcagtcattgagaacactgactccgtatccgtcctcagatacatccatccacttatgaacacaaacctcaaacttggcaaaatcccaggaggtgttggcatgagtcggacgttttacattgccgtactggatttcaaaggacgcctcgctggtatggatatccaccgggaacagagccttcagaaaaatctgatgctctttccagtcgatctcattcctgatatcaatgcgggccgtatcccggtaaatgcagatatactggctgatgactgaatccagataattcctggttattttcaaacagccccgcaccggaccacactcttctgcccggatctcctccacatcatcaatctcccaggatttttccgtataataattgttcagatcccaggcatcataattatgcggtctgtcctcataactcatgagcacattagcggccttcccttccggaagaagctcacgggcagctctcttgtcgtagatgctgataaactgtcctttttcgttcagatcaattgagaaaaatgcattttccatgtgactttcagatacctgaatatggtcttcgcatttctcctcaccctcttcgagcaggaaggttctgtaaccctttgacggaacgtcttttgccgtaaacatccaggtgccgtcagcttttttctgtacgggaagaatttcctcccctgccttcactgcgggataacggatctcatccggacaccaaaaagacaccacatcctcagcgctcatactgttggggttgtaaaccacaagggaatgtgccggcgcgttgatgcattttgccagacccgccagttttccgtctgtatactccctgccggcacggagtatggcctcatactcctccttggaatcatcgtaaacctctttgatcgaagaccccggcagaatatcgtggaactggtttctcaggatcacttcccacccctcatggatctcatgatcgggataggcttcatggagaagcctttctcccaaaataccgtacagttccatgttctgataagcaaattctgacctgcggttatattttttattccttgccatagaggtatatgtgcctctgtggtactccagatagagttcccccacccaggagggcagatatttctttccccgcaccttttcatccagcacatggaaaaactgctgggaagtgctcataacggttttgggacagccaggaatgccttttgccagacgcctctggttttccagcatatcctttgtaggaccgccgcccccgtctccgtatccgaagctgcacagcacttcatcgttgagatacttctggctgtagcgcttccatgcgcctttcatctgggaaggattgatatatccgttgtaggtggtaaaatgctctgtctcatatccgccttccactgctcccttgttgtaatccctggtgggtacaaaatgggtcagtatcctggtgccgtcaatgccctcccactcaaaggtatcgcagggcatcttattaaattcgttccagcttatctttgtggtcatgaaatagcggatgccgcatttttccatgatctgcggcagcgctgctgagtagccgaatacatcgggcagccacaagatctcattgtcttttccgaactcatccctgaaaaagcgcttgccgtggacaaactggcgcaccagagcctcaccggaggcgatattgcagtcagcctccacaaacatgccgccctctacttcccagcgtccttcctttacgcgttctttgatctcttcataaacctcaggtgcatttttctttacatatttgtagagctgcggctgactggacatgaatatatattccggatatctgcgcataagctccagtacagtggaaaagcttctcacagccttatcctccgtaaccttaagggtccacagccatgcacagtctatatgggtatgtcccacacagtagatataggcatcactgtccccacagtgtttgtcataaaattccctggtgatatactcctgcgccgcctccaaactttgataatactccttggagccttccttcctgaaatccagcaggttcagggattcattcaggcagttcaggatggtcagatatgccttatcgtcctccggcagaagctttgccacctcataggggacagataagtcataaaaatacttctctgtctttctatccagcaccttgatggctgaacagagcctgagggaaaagttctggtcacctgtaaaagctgacaggataatgcggtactcctgccctttgcaggccttttccgtaaggatgatctctctgtggttcacatccagcccctggatcctttttccgtctacgaaaatggaaaactgcgggttggtggcatcccactccccttctcttcctgtcatcagctcataaaccacacattccccgtcaaattctgcgggaatgaccacctttgtctcaaaccagtaatattccctgtgcccgccccagagctgttcccttgtaagtacctcccagtcagaggtatccaggttcccaacgtccgaaaacgtttcctctgtcttcttcatcctgtaatcctgaatctcacaggacctggggtaaatctgctcctgcaggtattccagcagcttgccgatccgttctctcatcaacaccatgtaaaaattcctcccgttttcgtgttatccttttgctgcacccgccatggtaaatccttttgacatatagttctgtgagagaatgtacagaaggatagagggcagtgcataaattgcggagtatgcggcaaggggaccatactggatggttccgtgctgtccgaaaaactggtacagcataacagatgccggcatcttctccggtgaacttaacaatatgtagggaataaagaagttcccccagcttccggaaaatgtatagataaataccacacagattcctggaaacatcaatggcgccacaattttgcggatagacttcatggttgtagcaccatccacccaggcagcctcctccagttccaccggaaccccgtccataaagtttttcataagccagattccgtaagggagagaggatgcagataagaagagcaccagtcccggaatactgtctaacagcccaacgctgagaaaaattttatatacaggtacggtgacagcgatcataggaagtgctgtcataaacagaataacatacatgaatccttttttgtagctcaaatgatatctggacagcggataagctgcaagccctgaaatcagtaccacgatcagggactgggcaaaggaaatgacaagtcccacaccgaatcctctcagattgtcagagtttgtcagtacatcactgtaattgctgaaggtccactgtgcgggccatttcaaagcctcacctgcattggtatccagagacgcgatcactacccacagaagcggaaggataaacacgatccccacgatcaccaggaatgcacaatgcagggtttttatcattttttcactcattctaatccctcccttactggtccttcaaaattctggtatagatcacgctgcatacagcacccacaagcagtatcagcataccgatggctgtaccatatccaagctgcagacctttcagtccctgattatacataaatataggcagcgttgtggtggatgaacccggtcctccgcctgtcatagcatagatcaggccgaaaacgcctaaagtggataaggtgttcagcatggtattggtggcgatggtgtccttgatgcagggtacaataatgcggacgagtgtctggaaacggttggctccgtccaccctggccgcctcctcaatatcccctgacacattgtcaagagctgactggaagttcagcatggaaaatgcagtgccgtgccatacattggcgatcaccacagtcatcatagggtgcttgaacagccaggataccgccgggatatgaactacgcctaaaatcatgttcatggttccgttgtccttaaaaaatgccatacagcacagggcaactacgatctccggcataacccaccccgccaggatacagggacctacaacacttctcaggcccttgggtttccctttcatgaaatacgcgatcaaaaatcccaggatactctgtcccagaaggctgcccaccaaaaagagcagtgtgttcttgatgctggtcagggtactggggtctgtgagcatcctcttatagttctcaaagccgataaattccacattttttgcgtttgccccgctcagtgccaggttggtaaaggaatagtatacggtcagtacaataggtatgataaaaaaacataaaagcagcaatactgccggaagcagcaggatagatttttttgcctcgtcttttatgacagccgcacggcttggtcttgtcataaaacgccctcccttcaatcgtgaaaaaatatgggcggcggcactttacggtgccgaaaccgcccagttgctgatcatgccggaattatcttccgggcagccttttatttctcaactacattgtcatcgcctacggcacgtgccacatctgtagcatactgtgtcatggcatcttccggagatgtaccggatactacagattccaccatggtctgaatactggtggtgacagtggaatacttgtcattctgcggtctgaaatctgcactctccagaaattctgttgcaatctgtttgaacggctgtgcggagtatttctcatcgcttgctacgtcctgtctggtggcaatattaccctgtgcgatcacagcatctgtgtaaactgccggatccatgaggtgtttgatgaactcaaaggtctcgtctttggcatctgaattttccggtatggacaatgcccagccgcctgccagtgttatggttccgggatcctgtccctcagaggtaggcatagatgcgaatcccagcacgtccttagcctccggccacggtgctgcgcctgtgtctgtccagttgcctgtgatccagcttccgtcaagggagattgccagcttgccctccggcagatattctctggcagatgtattggaagcctgaccatttaacacgagagaaagatccggtccgtatccgtttgtgtagatatcctgcaggaagttcagggaatccagaatgccctggctcttaacgatccatttgtcgtcatcagaaagcagtctctctcctgttccgtagagcagcatctcatatgtctgcatggaagtcgcctcaccggtagccacaccggagttgcaccagaacggtactacatccggacatttttccttaacggctttgcacgcgtccagaatatcgttccagttcttgggctcccagtcctgtcctttgctgatgacaccagcctgtgccagaatgtccctgttataccataatcccctggtatctgtacagtaaggaacgccatatacagatccgtctgaacctgtcacaccttttttcatggaatcatagtaggctgtattccagtcctcataatccttcacgtaatcatctaattttgtcagatagcctgcgctcacatcattgggaagctggaatgtatcctcacaaaccaggtccgggcatgtcttcttatccgcaagctggagagctacttttgtaaaataatctccttcctgagccacaataggagcaatattcagatcgactgtatcttttttatcccaggtatcgtatccgtcctggatccatttccagagtgcgccgtcctcaccctgaccgtcatccctgaaacagaaggtaatggtcttcttcccgctgtccgcttcctttttctcaccgctgccggatgaggcctctttgccgcttccgccgccgcaggctgtcagtcctgctaccatggcagccgccaaaaacagacttgtcacttttttcatcttcatactcgttctctccttttgtttttttgatgagataagaataccattttttcccgttgggggatattccacatatttaagaaaggggggtatttatgaccaccctctaacgtttttttataatgataagcttcacagcattctgaagctcccgggctgtgtcttccggtgaggttcccctgacctccatcaggttatagaggctctcagatacctgctgggcgatttcaaaccaggaattgttggtctccgcataccatccgccgttaatataacggttgagaaactccgtcccttcatccggcccgatacgcttggactggtacggcaccgctgcttttacaggcagggtgtccatggcattgcagatccgctcctgaatatcattttcatagagatatgtgaggaagcggtaagcctcccggtccgcgtatcctgtcactccgatattttctcctgaaagcatcagggattccctcacatcactgggaagaggcacaatgccggctgagaattccattctggagctgcgcagaatggtggatgcgctgagcctgtttgccatcatcaacacctttccctctgcaaaagagcgggccacgtccgcctctgtgagattgatggtctgctttcctatgtaccggctgcgcttcagttcttccagaatactgactgccttgatcccgccttcctgatccatggtattaaggcttccgccgcaggcataaagcagtgatctgtaaaaggcataaatctcctccggacgcttggccgcaaatccaaacttatcaccaacactgtcctgcaaagcaccgcaggtatccagaagcccgtcccagttctccgggacagacaatccatttttctgaaatacatcacggttataaaagagcacatagggatcacaggtaaagggaatgccgtaatatttcccgtcatccatggtggtgttccacagcttctgaaaattcatgctgtcctggcaggattcctccacatactcagaaatatccgcaaatacacccatatcgatcagggcaggcatcataccattgtcacaaatgatcagatctgctgtttttccgttatccatgcggagacagatttcttttttaaaattttccttggggataaactccatgatcacttttgcacagccggagcggctggaataattctctgccacctcatttaaaatctgctgatgaagttttgtctcataggcgctgagtacatatatctgcttcttctgctgttcttctgtctcctgcacctctttctccccgcccttttgccaatggaacagaacggccgcggcaagtgcacatagaaagaaggcagcaagataccatctctttctcatttcccattctcccttttgtattctgagggtgtgacaccgcttagtttcttaaagacttttacaaaatatttctggtcatggaagcccaccatctcagccacctcatacaccttataattgccggacaggagcaggcgcttggctgtgctgactctgaaattctgcagaaaggaggtgaaattcaccccggtttccctacagaagatacggctcaaatattctggtgtgacacagcacccctctgcggcttcagacagagtgatatccctctggtaattgctgcggataaaatcgatcacattgagtatcatcccgttttctgtaatatccagtgtttccctgctgctggcaactgcgttcatgatcttctcaaactgatatctcacctctctttttgaagtgctcctggcaatgctctccataatataggaggtgttctcccccgcgtccagacagcctctggtctcccccgccacccggaggatccccgcggaaaacctgagcacatactcccggatacaggccggctttccctcactgtctatcactgactttgcaaactgttctccggtggcgcgtaccttgtcatagcgcccgctgcgtatttccctgtaaatgctctgctccagataatcgggatattctaaatccctgtactcaatggattccacaagttccctgctgagtatggtctcatccggcagagaaaatgcgtactgcatcatatccttcagctccgcaagcttctcattcagctctttcagcccgtaaatggtcccatagctgcagtggcactctgtgatctggcagagggaatggtagatcctggtcttgaagatcttaaaaaggtttttatttctctccgtgtcggtcagcatcaccagaaacccctgctgccttggcagagacatgacataatagttttccatgcacagggaatccagcagctccgttgtgtgcttctggagttcacttcccgtctcattggccagactgcagggatagatacaaaagagtgtgatctgtgtcctgtcgtctgcctgcagggtctccctgaggatcggctctgtctgctgtctctccacatctgtgccggtaaagtaggtccaaagaagctgctccgcagacaccttttccacccggtttttctcgatattcccctccacctttcgcagtacctccagaaattcctctacctctaggggtttcagcacatactccacaacctgaagtttcagcgcccttcgcgcgtattcaaactcagaatatcctgtgagaagaacagcctgtacttcgatcccctctttcaggattccttccagcatctccaggccccccatgacaggcatcttaatgtctgagatgaccagatccggtctgtgttcctttactgcctccaacccctcttttccgtttccgcagactgctgccacctcatactccgtatcccgggcgagtatatttaaaatcccttctcttgacttcggttcatcctctactacgattattttcatattgtcttcctcctactcatagggaatcagaatggttataacagtcccctcctggtttgattccacatggaagcttccctgctccccataataaagcttgatcctggttatcacattgcgcacaccgatgctggattccacacgctctttcttatagtcaaaatgattaaaatactctgcctgcccctcctccattccttttccgttgtcttttaccactatggatattttttggtctcctgcttttgtcaggcggatattgatctcatccatgcctgtatttccgggaaagccgtggactaaagtgttttccagaagaggctgtatcagcagtttatgtattctgcacttcatcagattttcatcggcctccaccgtgcagatgaaagagtattcaaatctctgctgctgcaggtatacataccgcttcagatattccagttcatctctgatctccacgatctcattgctcttgtgaatgctgtacctgaggatcaaagccagactggtgagcattttgctgatgctgtactctttcctgtctattgccacccagttgatagcgtccagggtattatacaaaaagtgtgggtttatctgtgcttccagagatctgatctccgcgtatttttcccgcacaagggcttccttttcctgctcattggaagtccggatctgtctgagcatactgttaaaatgtctgccgatcctggcaaactcgtccataccctcctccggtacgcgcacatccatatccccctcgtttgccttatccatggcattcagaatgggtttcacagagcggtccatttcttttgaaaaggagacggcgatcagcacgcagatcacacctgccagaagccccaccaacactatgagaaaggtcagattgtgcaaatctttcaacacatagttcagatcccgcacattcaccacataaaagttctggttctggacccctttgctgcgcacagacaggcttgcccccctggggataccggttgtcctccacaaatttctgagctgcctgctctatttcctttttgctcctctcctttttctcctccccggcaaatatacttctttccccgtaatttccctccggataagagataatatcaccgtaccggttcaccacaaatgtgatattggattttgtgctgccctgcttgtatacatcacacagtgctttctcatccacacacagcaaaatgcatcccacaggcccttccttgtaatcgttaaagtccgtgagctgatgggccacatagaaatagtccttctctccatatctggtgtccagtttatgatacgtcctggaatagacggtctgcttttccgcataggcctgctttaccatctcattgtttctgatattgtccaggtcaaagcaaaagctctccgcgcctgataaggtcatgctgtcataaaagcatacatcaccgtaaatgcccgtgaccgcgattcccagtatatctttgtttatgtatacgatattctgcaggttttcctcaatcttatgctttgccaggtaaaatctactgctgtcccagatattgatgggttttagattatccacataggtctggtctgtataaatatcttgtatcagactctcaaaggtatctaaaaagttctgcacgtttccggatgactgttccagattggcttcgatcaattctccggtctgcctggttatggtagaggcgctctgtctgtaagagatcagcaggacaaatatgatgggcacaagggaaactcctaataaaagcacaagcatccgcctgccgattcccagtttttttagtcttttcttcaaaatagttctgttctcctcctttccattgcagtatgttttatgtatgtacattggggatttatattctctctataaaaatacataatttcccatgatgagatacttctccattttacagtatgttttcttctgtgccaaggtagagatatttgacttttggggtgtattctatatataataaaaaataacttgtaactgtaaggttactgaacagttgtgataacttttatgataaggcggagacgcagatgaacagtaaaattaaaattattgaggacctttccctgaatgcatggccctcacatcagatgcagatttatgatggatggatcctcaggttttcttatttttatacccacaggacaaactgcgtggaacagattgggccgtcttctatcccgctccgggataagatcgcgtactgtgaggaggtctatgccaaatgggggactcccactatttttaaaatcaatccgctgatggacagttcttttgaccagaagctcatggaacgcggatatcataccgcccataccacagaggttatgactctggatctggaaaagtataagatacagaagccgcccagaccggtgtttctcagcagggaaatatctccggactggctgaacgggcttttttccctgaaagggactgtgaatgagatccataggaagatagtgccgtctatgtacagggctattcctaaggatactatatttgcgtctatttatgatggggggcgtattatagggacaggactggggatattggacagggattatgttgggatttacgccatacatgtggctgaagagtatcggaggcagcatttgggggaatctatctgcaggtctattttgaattcggctattgatgaaggggctacggaggggtatcttcaggtggttgaagggaatgtgggggcacggaggctttatgaggggttggggtttgaggggttttatacttattggtttcggcaggaattttgattaaaaagggatggagaaggcggacggagacgagcagggggaagcggggcggacagtgggataggacagacgaagcgttccgctgcacagaagctaacctgctctcattcactaagctcgtcggcattggcctcctcgctaagtgactgaggcaggtggatcttctgcacgctccactggaacatcgcctgccctatcccactgtccgccccgcttccccctgctcgtctcctggttttggctgttggcttttctggatgactgccggcttttctgatgactgacggattcttcttttggacgctgacttttatgaatggttggtgccttttttagatgactggcagctttcggaatggctggtggcctttatgaataactggcagcttttccgaatgactggtaatctttgtggatgactggcagcttttccaaataactggtggcctttatgaacgactgacagtttttcggaatgactgccaatctttgtggatggctgacagcttttctgaataactggtgtctttttggagggctggattttttgtttggttttttgttttgttatctcttggtttgtgtctttttaatcttgttttttcttttgatcatttcacatcatattattaggtattctaacgctacagtggatatcgtgaatttcaaatactatgacgaacaaaagttgatctataaataaatgggggtagtattggatcaaattattctgcgtattggatttttgtcggcggcggcttgtctttatttgtaggttggctctggtattgcggatgttttaatctgtgatcagattggtttttactgaggtgagccaggtttctatggattgggcgaggaggtattgttgggttaggacggctttggcggtttcggggatttgggggttgggggttttggttgttatgttttgttccaggttggctttcagggtttttatgctgctctcgatgttttcaaggcaggtcttttgagcctggggcgggaggctgtccaggtttaccattacggcattaaaatccagaaagatgttgatgggctgggtggatattccaaacatcagggtttggaactcctgctcgccttcttctgtaagggaatagacggctttttctgccatattcccctcttttatcatggtgcttttgatgaagccctttttctcaagctggatcacctttttgtatatggagggcgtgctgatctttacccagcgggatatgttcctgtactctaccagcttttggatgtcatatgcgctcaatggttctttttttacaattcccagtacaattaaatctatggttgccatgttgtcaccttcctttttatttttcttgacagttactataaattatagtagtatgtatcccaaggctctgatactataatttatactagtatattttataactattgtcaagcgaaaaagaaaggagtctctgattatgagtaaggagaacaaaaaaatggaactgctgggcagtgcgcctgtatggagggcacttttggcaatggggcttcccactatgatcggaatgatgatcaatgcattgtataatctggtggatgcttattttgtgggcggactggggacgagtcagatgggggcgatctctgtggcatttcccatcggtcagatcgttgtgggacttggactattgtttggaaatggagctgcttcttatatttcacgtctgttgggaaaaggggacaaaaatacggctgatcaggcggcaagtacggctctgtacagcagtattgctgtgggtgcagtagtcattgtgtgtaccgttgtctttctgcgtcctgtactagaacttctgggggctacggagagtatactgccttatgcagaagaatatgcccgtatttatgtggtgttttcgctttttaatgtgtttaatgtgactatgaataatatcgtgacaagtgaaggtgccgcaaaaacaactatgctcacactgcttgccgtggctgtgctgaatatcattttggaccctgtctttatctacgtcctggatcttggcgtggccggtgccgcggccgccacggctgtttcccagatgctctcctctgtggtgtatttgagttatattttaagaaaaaagagtttcttcagtttccgcgtcaaagaatgttgtttttcccggaaaatcatttctgaaatattaaaaatcggtattcccactatggttttccagcttctgaccagtctttctatctcccttatcaattttcaggcaaaggaatatggggactctgtcattgcagggatgggtcctgtgacaagaatcatctccgtgggcagtctcatggtttttggctttatcaaaggttttcagccaattgccggatacagctatggcgcaaaaaaatatggacgcctccaccaggcaatacatctttctattctttggtccgctgttttttgtatcatttatgggggatttaccgctttgttttccacaactcttatctctctgtttactaagggggatttggaaatgatccaaatcggcggccaggcgctgagagccaatggcctttccttcctgctgttcggattctacacggtatattcctccttgtttctggcactcggaaaaggaaaagagggatttatcctgggttcctgcagacagggtatctgctttgtgcctattatcctgatcctccctctctttaccggtatcaatggcatcctctatgcccagccggccgctgatgtcatctctgctgtggtaactgtattcatggcactgcgccttcacagagaacttcacaggatggaagaccatgtgacaatgccgcttagcaaccatgcggctcaccttgacagagaaatataaaagatatttaatgtggttgactcccggcagcttttatgggataattaatttaacgatgagttaattaattatggaagggcagtttctatggcaagaaaaaaaataccggaaaattatgaaaagatgaggcagtgtattatacaggccgcaatagagatcatggtaaaaagttccatggcagaattcagtctgactgatgtggcggaaaaactgggattgacaaaggccgctatctactggtattttccgaataaaaatgctttgatggcccaggccgcccaaagcatttacaatacttatatcggctatatagaaaaaatcagcagcagtgatctgagttcctatgaaaagctgcgcaggatcgttctcggagaggatgacaccatacaggctgccctcatgtgtttatttcccatcaagttttacctggaatactattcggagaatcatgtggtaaaaaaccttatccaaaacggctatgagagatacaactgccttatcactgccctgttggaggaaggcatccgcagcaaagaattccgttgtgatttgccctccgaggagctggctaaatttatcacaggtgccatcgacggactggcattccagaacctgctggtctcatctgaaaaaacagaggtatccagaaccattatattttccgtactggaccgtatcttaaaacccggccgccaatcatcaggaagagaggaacttaatgactaagaaaagaaatctatggagtatgatactcgcagtcccgtttattcttgcagttttaatctgtttcattgtaaactttgccctggaacaaacgttcagttggtctgtcctggtggctgcctcctgcttctatgcatacctgatgctgtacaccctgatattcggacaaaagcaccgtattctactcacttacctggtcctcggtatcctgctgatacccttcctgtacatcatagagtatactgctaatctctatatgactcagcctatatactgggcagcaaagctgtataaagttataattaataatgtacaaaaagtgtggaataaaaatgtacaaatgttatgatacatgagctaacaggaggagctcataatgatattaaaaaatcacatcataacagatcttgaaatacatagtgtcaaagatttatataaattaaaaccatttttggaggattctactttgaaaattaacaaaagtcagattgcacgggaactggaagttgaccgtcgcactgtggataaatatatcaacggctatcagaagccaacagtccgtaagtcgagagattgtattgctgcccattacgatattattgaagagctgctctcagaccgaaatcagcaggtattttattaccgtaaagtcctgtggcagtatctggttgataatcataactattctggtgcatactgcaatttctgctcttatttaaaaacttaccctgagtttgattcttatttcagaaggcacagaccttccaatgtcagccaggtcacggtacgttatgaaacggatatgggaaaacaggctcagcttgactggaaagaatccattccttttcttctttccaatggtgaaacgatagaggtgaatatttttgttcttctgctatcttattcccgattccgtatctataaagtatctctcacaaaaacacaggatatcctattctcgtttctggatgaagcatttgaaacttttggcggtgtacccaaagaaatcgtaacagacaatatgaagactgttatggataaagcaaggactgaatattctgacggaaagataaatatacgcttccagcagtttgcagatgattatggatttcacatccatccatgtattgccggacatccgcatacaaaagctaaagtagaagcgcccatgaaaatattggacgagattagagcctataatgggaagctggactattgtgaattaaatgaattagtgaaacggataaacaaccgggtaaatacccaggtaaaccagggaaccggacgtatccctctgctgtattttgcaaaagaaaaggctttcttacgcagcctgcccgctgataccataagaaagccttatcagatcacctgtcacacagcaaaagtaaatcattccagtctgttccactatcagggaaaccaatactctgtaccaccaaagtatgtgggaaaacaagtcaccttgcaagtgtatgatggttatatccatgtttattatagcacagaattcataactatacatacaatcagtaaaaagaaattaaattataaaacagaacattatacagctattgccagaatgtcccatgctttccgggacgaaaagatcgtggacagagcaaaagaaaatttggagaccatagggagaatttacggttatgaataatacagcatatacacaattatgcagcaacatggaacagctgaagcttacccagatgctcctgcatttggacgaaatcacggattttgtgacagtaaataatctttcttttacggaagggttactgaaactgagtaattatgaggtggattttaaagaaaagaacgcatcccgttccatgatcaaagctgccgcttttccatttgtaaaagaattgaaagattatgattttgaatttcaaccgaatatcagtgagcagaaactacgggaactgtgtacacttggatttttggaaaaaagtgaaaatgtagtatttttaggccccagcggggtaggaaagacccatcttgcaacagccataggtgtggcagccgccaaaaaacgggtcagtacttatttcattaaatgccacgatcttctccagcaattaaaaaaagcaaagttagagaacagactggatacaaggatcaggcatttttgccattataaactactgatcatagatgaaattggatatctccctattgacaaagaggattccaatcttttctttcaaataatagataaacgctacgagaagaaaagtaccattttaacaaccaatatgaatttcaatgaatgggatgagatcttttatgatgttgttgtgtccaatgccattttggacagagtgcttcatcattcccatgtgattacaatatcaggaaaatcttaccggttgcgaaaccacattcaaccaaaagattaatgtacattcttataccatattttttgtacattttgtcttgacattttataagctgggagcgcccataagtcttgcctggctggccgcccttgcagttaccggccttttcaggaccctgacacatgccaatgttttcctgaccatgggctgcctcatccttgtgttttactttgcagagcgttataccaataacaggatagatgcttttacaggttcatcccaatcctggagcctttcggatcactaccccatcctctattttggggctgccgggctttttctcctgaccggcatcgtcacctctgcggtgaagcgcctcagtccccgtacataaccgggccatccggaaacgaaaaagagatatgacatctgcctgaacgaaggcttccctcaaggaaactccactcatacggcaatgccatatctcttttataagatcaatttccgctctcttatgtttctcctgatcccctcaggttccccataaaagcttctgtcctgattcctcagtgacaacagcagacagaaatgcaggaaagcggtcctcttttttcattccttatctgaaaaataattctcctaactgtaagtccctcttaaagctgcggatcctggtatcctcatcaatgtaaaccgcctcgattcccatagcagcagcccagtcgcccatctgctcagacgtgatatcataggaaaaggctgtatgatgtgctcctccggccagtatccaggcttccgcaccggtagccagatccggctgcggtgtccagaatgctgtagctacaggcagtttaggcataggcttttccgtcttcttacagtccacatcattgatgatcaggcggaatctgttccccagatcgatcagagaagcagcaatggccggaccggttttcgctgtaaatacaagacgtgccggatcttctctgtctcccatgctaaggggatttaccttaatgctgatggggccgtcagaaatagtcgggcacacttccagcatatgagcctgcagtattccttccttgcccggaaccagattatatgtataatcctccataaaggaagtaccttttgcccctttcattcctgctgtcatgatcttcatcagacgtaccatggcggctgtcttccagtcaccttcgccgccgaatccatatcctttttccatcagtctctggatagccagtcccggcagctgtttcagggaacctaaatctccgaaatgagtcacgatcgcctgatagttcttctcttctaaaaatctctcgaatccgatctcaatctgtgcctgtactgccacatggcgtttaaactcctccgggtctcttccctccagaagaatctcatatttgtcgtaatactcttccacaagagcgtctgtatcaccctttgacacagcttccactgcctctgcgatctcatttacagggtatgcgtcaatctcccagccgaacttgatctgagcctctaccttatctccctctgtcacagctacatttctcatgttgtctgcgatcctcataacacggatatggctgctctccataattcccactgctgtgcgcatccaggacgcgatcttttcctgtacttttctgtcgctccagtgacccactgtcactttgcgctcaatacccatgcgggatacgatatgaccatactctctgtcaccatgggcagactgattttcattcataaagtccatgtcaatggtatcgtacggaatctcctgattgaactgggtgtgcagatgcatcagtggctttctgtactcctgcagtcccaggatccaagatttggccggtgagaaggtgtgcatccatgtgataacgcctgcacattcctcatcctgatttgcctcattaaaggtctttctgatcacttcatttgtgatcagagttggtttcagtaccacttcataagggagtacccctgatttatttaattcttctacaatgatcctggaatgttccgctacttttttgagacactcatctccgtaaagatcctgggaacctgttgcaaaccaaaacttataatttctgcctgtcttcattaaactcaccctcctgttaggttttatctttcttccatcataaaacttgtacggttatctttacaagttgtattcacagaaaggatacaagtttttcagttgtatgtttttggccgcatccatctctccggggaggaaaaaccatcctcaaagttttcaaattcctcatttacatctatcagggaactgatataacagcggatcctgttgctgccccctcctgcttccttgaacagacgggtgatacgctccgccacacagaagcagttctcctgagtgattcccggaagcataatgaggaactgacaggagctgtacctggtgtacagatccccccggcgcagggacagcttgatggccgtctggaacttttccgctgccttgcttatcttatcttctttttccatgggaatgcctgaactgtcggtcagtgtgcacagcatcaggaacacggacattcctgtcctctctgtcatgcgcgtgatgatcctgtaagtatcaataaaactgggcagggagcagaaataagcccctttcccttttgtcttctctctcagatccctgcggatttcccacatatccgaggggacaccctgtatctggctgctcatagaatgaaagcgctccagcattttctctgaaggcttcaaaccaaactcgttaaaatacagggatgcagtctcctcatagactttcagtgcctccttgtgacgattcagagccagcaggctgtcgatccgccagagctgccattcctcatagggatatatggacgcggcgcgggtgctgatatggagtatatcctcatattccctgcgctccttcagaatggaaaacaactcgcgcatacagtcaaagtacagatccctgtactttacacctgctattacagaccaggcctctgctgctcccggaggaagaaactcccctttatacaggctgcaggcctctttcaaaagctcttccctcttctcaccgttttccatgcgggcttcctcaatggctgcctccatctgatgaatatccacaactgcttttatcttctcatcccatctgcagattcccttttgcaccgttatgtatgagccatccggcataccagcctttttcagttgtctgcgcagtctgaaaattgtattgttcagactgctatttccgttttccacagtatctttgccgtaaagtgcgtcgatcagttcagccttgtctatcccatcctttaagtgaagcatgagaagctggaacagttgtacaaattttgccgggctttttctgtcaaagaccactgctgccccctcataagaaatagaaaaaccgcccaacattcttaccctcataataccggtatttttttctctctccatctttttatatctcctgcaatccgagtaccgttaaaaaaggccgcccttcatccaggacggcctctctttttcatatctgctctctttttccttaaatgttcaatatttatttgttgctcaaatattcctcgatgcttttcatagcttcgacttcgtcttcgccttcaactgatacagtcacgctctcaccagcgtctaatcccaaactcatcatacccatgatgctctttgcatttaccttcttttcctgactctccagatagatattgctggcatactggctagctacctgcacgagtaatgcaatcggtcttgcttccaagccgtttgaaataccgatggtaattggtttactgatcatatctgttcctccttgttccctctgagctcttctgctatgctgccgatcctacgcagtctgtgattgacccctgactttcccactggcggtgttaaaaacatgccaagttctttcaatgaggcctgtggatattctaaccttatccgtgctatctcttccagattgtccggaagtctttccaatccaatggtgtcacggataaaagctatatcttccgtttgttttactgcagcatttacagtcttgttaatattcgccgtttcgcagttaaccttgcggttcacgctgttgcgcatttctttcagaatcctgacattctcaagattcatcaaagatacatttgcccccataaggcctaaaatttctacgatctgcgcgccttcttttacataaacaacctcatgcttcttgcggcttacaacttttgcatctacctcaaaggactgcaccagttcctgaagctgctgagcttttgacagtgtggaacatacgatttcaaaatgataaaatttctctggggcactgatagaaccagcacataaaaatgcacccctcaggaaagccctcctgcagcaattcttctgaataatcagaggattcacaagagcggcacagggcattggctgcctgtctgctgtcagatactttgctgcctgcaaaattctcactgtatcttcctgacctcgtacttcaatcacaaatctgttgtttctttttattaaacgtttatctatagaaatttctttatctattttaaatgttttttgcaataaagtaaagcactttcttataacactttcattttctgtagaaaaacagagaaacggctggccttcctctgtcctctgtatctcaccgcaaaagctgaaaatggctgaaagctctgctatctggcaatgcctggcagggctgatacagcgctccagctcctgctttacgcttccggagaatgacatttcttcgcatccttttctatatctctatgttcgatccgtatcccgtattcttctgactttttcagccgtctgtatagttcattggccagagtcacactgcggtgtttgccgccagtacatccaatggaaaccacaagctgggatttgccttcggatatgtagttcgggatcaggaaacgcagcatatcctccagtttatcggaaaactcctgtgccagatcaaagcccatcacatagtcactgaccggtttatcattgccgcttaaaaaacgcattccttctatataatatgggtttggcagaaacctcacatcaaaaaccagatcagaatcaccggggattccgtacttgaacccaaaggagagaactgtgatcatcaggttcttaaacttctggttctccacaaaaatcttttccagctcttccttcagctctctggtgagaagctggctggtatccaggatataatccgaaaattcacgcagaaaagccagtctgctccgttccagtttgatcccctcatctacccttccgttgccggaaagaggatgagagcgccgtgtctccttgtagcgctttaccagagtcttgtcatccgcatccaaaaacaggatctccggctggaatcccggcagccgcagcctctccagaacctgctccagttcgcttaaagccttgccgcttctgatatccacacctacagccacacgctctatctctcctgaacttccgtcctttaccagttgggcaaacttttctatcaggagtatcgggaggttatccacacaaaaatattccatgtcttccaacatcttcagggccgtactcttaccggcacctgacattcccgtcacaattacaaaacgcatatagaatcctctctgcctgtgtcagaactcacccaggaatttcacttccggctcaagtgtgacgccgaatttctccctgactctcttctgtacttcctctatcaggttcttcacatcctccgccgtggcatctccggtattgacaacaaaaccgcagtgcttctctgaaatctgcgctccgcctacccgaaaaccgcgaaggcccgtatccatgatcagtttacctgcaaaatatccttccggccgcttgaacgtactgcctgcgcttggcatatccaagggctgcttgctggtgcgccgctctttaaaatcatccatctgttccttgatatgggatgcctcgccctttttcagcctgatcactgcctccagcacaatataacctttttcttttacaatacttgtccggtatcccagattcagttcctcccgcttcaggcatattacattgccttccgcgtccatgacagtgacttcctccagaacatccttcatctctcccccgtaagcgcctgcgttcatgaccacagcgcctcctaaggttcccggaataccgctggcaaaggcaaacccggccaaactgttatccagggctaccactgcgatcttagagaggagcgctcccgcttttgcccgaataacatgggcatccacctctatatcactcatattcttccagagctgaataacaacaccttgatatcctttatcgctcaccagcagattgctgccattgcctaaaatgaaaaacggcagattctctctcttgcagatatgtaaaatcttccgcagttcatccacactgtgagggcgcaggtaatattccgcaggtcctccgatgcggaatgtggtatgcttcttcattggttcatagacattgacattgtcactgcccagacactgacaaaactcattttctatttttttattcactctcttacctcttgctttgatcatattatataaatcttaagtaactgtcagatactttgacagttacgagcaaaaacagtttcagacagaaattttattttctgtctgtcttctgtctcatcccgattaaatcttttactacctctccggcgatcatcagcccggcaactccgggaacaaaggaaatgctggagggcacaggcctgcctgttgacggcctggtctcttccgtctgcaccttttcttctttcaggcccatccggcgttttttttcttttggcgctatttccgtggaaaaaagcaccttaaccttttttatttttctctttttcagttctgtgcgcatgacctttgccagagggcacacactggttttcgcaatatccgcaatttgaaagcaggacggatccagtttattaccggttcccatacaggatatgaccggcttattgcaggcttttgccttctcaatgagaaggatcttggcagagacagtgtccactgcgtccacaatatagtcatagccggaaaagtcaaataaactggctgtctcagccgaaaaaaaagtctcataggtgtgaaccactgcatcctcattgatatcggcaatacgctctttggcaacctgtacttttttccttccgatagtagaacgaagcgctaccagctgtctgttcaggttcgtcactgcaacctcatcgtggtcaaccagaatcaggtttcccacaccggctctcgccagagcctccaccacataggaccccacgccgcccaggccaaacactgcgaccttggaatcggcaagaatctccagcccctcttttccaattaatccttccgaacgggaaaatgcatgcagcatacttgcggttcctcctaagtaaaaactatttaagaataacggctcgcttcacgggctcgctattctttattgtaacgccttgactaaagtcaagccgtatcgaataacggctcgcttcacgggctcgccgttattcttcattatactattaattctatcaattgtatagaactagtttttcatctttggcttaaaaataatgctggccagataggcgaagatcagggctgcggagattcctacggcactggaggtaaagcctcccatgaagattcctatgaatccctgctctccgatggccttttttacacctttccagagaaggttgccgaatcccagaaggggaacactggcacctgcacctgcaaaatccatgagtttttcataaatccccactgaacccagcacagctccggtacataccagaattaccatgacacggcccggcagcagtttcgtcttgtctaaaagtatctgaaccagagcacagatcagtcctccgacccaaaatgcattgatataatccatatttactgcctcctgttaacctgctttagcaatgctccaccacaacagcctgggcgattccaggcacactttgcccctcattgtagctgacctttgacaagagtgctcctgtagggacaaaaagaacgcgtttccattctcccttctcaatcttcggaaggatataggaagcaaaagtcactgctgaacagccgcagccgcttccgcctgcgtgagtgtcctgggactctttgtcgtagatttcaataccgcagtccatgtgctgtttttcaatatcaaatcccttttccttcagcatgtcaaagaggatatgctgcccgatctcaccaaggtcacctgtgatgatcctgtcgtagtcctcaggcatacagttaaagtccatcatattctggtagatggtatcacaggccgcaggtgccatacatgcccccatgttcagggaatccttgagtccgaaatcaatgatcttccctgtggtaatacctgtgatcctggcctttccgccgtttgtgcccaatacacaggccccgcttcccgtcacagtccaggtggcggacaggggacgctggtttccgtatcccaggggaaaacggaactctttctccgcgctgccgaaatgactggaggtgactgccaccacatagtcgccatatcccgcggctacggccatggaggacagtgagagcgcttcacccatggtggcacaggctccgtacagaccatacacaggggtgtcaaaccccaatatgccaaaagaagaagcaatggtctgtgccagaaggtcacctacataaatagtacgtatctgccacttctccagttctgcctttccgattgccatgctgactgcctctttttgaagaacgctctccgcctcctcccaggactggcatccgaacatgccgtcctctttgccaaccacatcaaaatattttccgagagggccttcgccctccttttttcccacaatggaggctccgcttagaatatgaactgcgtgttcaaactggatgctctgtttccccactgtctgttttctcacttctgtcatcccaccatcccccataatttcagaacataatagacagcacccaaaaccgcagaggtcagaataccataaaggatcaccggacctgctatgataaagattttacagccgattccgaacacctgtccctctttctgatattcaatagccggcgccgccacagaattggcaaagcctgtgatcggcactaatgtaccggcaccgccccatttcgcgatcttaggataaatattaaatcctgtaaaaagcacgctcaagagcaccaggatcagggaagtccagcctccgctgatctccttgtccagtccctggctcatacagaaattcatgattccctgtcccagcacacagatcgcgccaccgcaaataaaagcacggcacatgtttttaaagaggctgtgggtgggtgtcacctgtttgacgtatttttcgtattctttggcctttttctgtttttcctgctccgccgcagttgccataactctcaccatccttttttctgcttccatatcgaaaagctttctgatagtatgagattgttatggaaaaaatatgtgcgtgaaaaaattattcaaaaagagaggcaagcccgcgtatgtgcagatttgcctcatctgtaggattgtcagcgcctgtcgttgtactgctcaaatccctcttcgatctcttttaaaatttttgcatatctcagaagttctttctgaacctctgctttgtcttcacgctcctgcttatagcataccctgtgctccatactggcccagaagtccattccgatggttctgatctgtacctcaacgggatagtattccgtgctgtcaatggtgcagacctgaatgcccagaaccatgtgatagctccggtatccgttctttttcggattggcaatgtagtctttttctttgatcaatatgagatcattttgctttttaagctgctcggcaagcagttccacatctctctcaaaataacagattaccctggcacctgcaatatcctgaaggttctccttggcatttgtaaaactggcgctgagttccatgcgctccagcttctcctcaatactctgtttctgcttgattctggactggatattgtgaatcggatgggacgcactgccatacatggaatggttcagcacatccagcctggcctttaaaaggttaagcgcatcctgatagggaacaattaaatcatagtattgttcattagtcatataccgtcctcctttatggacagaccatccccctgtctgcccgctccttctactataacataaaccggctgatccataaataaagacgggctgaactttttctaaaaggcttataaactgttattgttcccagccggtttgtcactgcataaaagatttaccggatatcatacacactgcggagtctgagtgtgtccgcatttccggataggattttcacttccttcgtgtcaccattcagatcaaaataattgtctgagaggacaagatcctcctcttcattgaggatttccacacttttcgcataggcagaggctgaaaccctgataatatttccctctttttcccaggtgagattgggatcctcatacctgaaatactttggataagagaatatgactgtaccctctgacaaaacctttgctctgccttccttttccggcatctcatggtccgcttctatggcctggaagctgacgtattcctgaaagacatccaccttaagaaactctgtcttgtccagccaaacggaagtgagggcaggcaccgtgatcacctgatcttccctgcgcagtacccttgccatcctgtcacgaagctgccagcatacccttatttgtctgtcttttaaggtttcatttgtcacattcaaacggatagatttttcaaatgtaaaatgctgcctgttcatgttggcctcccaggtcatccatccctcttcctgacaggagatcatcaccggggcaaaaaagcgtttcgcataataatggagtgctttccatctgccgccataatcgatagaggaccaggacaccacaggccagcagtcatttaactgccagtacacagcccccatacatcttcccctgtttctcctgaaatgctccaccccatagcggatggcatctgcctgcaaaagctgtgacgcatataaaagtgtggtaaattccgttggatagcggtaggtctgctgaagatagttcatgatctttccgttagccccgtaatttctctggtgtttctccatcacataggagaagatattaaagtcgtccgggtcatccgtaatctgttccagggtctttttaaatggaaatgcctgaaacccgaattcagaagcatagcggaaaaaatgcttcctgtactcagaaaaaggacggtttccgtgccagaccttccagtaatgcacatctcctctgtcaggatcattgggattgtcaaaagaacctcctgatgagggactggcaggccagtaaaaggtctgcgggtcgtattttgccaaaacctcaggaatgatgcgctcatacatgaacaggtaatccctcacctccgagggttttgtcacccagcatctctcatccacaaacatctccatctcattattgccgcaccacagaccaagggatgcgtgatgccggatcctttttatattgtccgcaaattccctgcggatattagcctcaaactcaggcgtcagttcatacacggagcaggcaaacataaagtcctgccataccagaaatcccatctcatcacacagatcgtaaaaccagtcctccggataacagcctccgccccagacgcggatcacattaaaattggcctcccggcaggcttccagcagctttcttgtcttttccctgccggtccttcccagaaggtgatcctcgggaatgtaatccgctcccatggcaaatatacatcttccgtttaattcatgggcaaagctctctccccacttatctttctcccggtgcatcgtcacctgccgcaggcctatcttcttttcccagacatctaataccttcccctgatagaacagtgtaacctgcacatcatagaggggctgaccgcccaggttgttgacccaccacagtttcgggctttcaatgaccagctcttttggggaattatccagtgtccaggttctgccgcccggttctgtgatcctgactgtgtatgtgaattcagaccattgaggctctacctgaaaagaaaggcggacccttccctctgtgtggctctgctgtatgtatacgctgtcaatcctggcttcacggatacccagaagggaaacctgacggaatatacctgcgtcgggaaggtgtgcgccccagtcccagccaaacatatagtgggcttttctgagatgcataaagccctcataagtgtcgtcatttccgatgtttccatattttttataggcttcggcaatgtatttcagaggagaacggaatatgatccgcatctcattttccccttcatgcaggatatccttcacatcgaattcccagatccggtgcatattaaatgcttttcctgcatgtatttggtttacataaatatcagcaagggtgtccagtccgtcaaagtgaaggacaactctctggttatccagcattcccggaagtaatgtaaaacggcattggtattcataatctttttccataagcgcacagatgcggtcctcattatctttccagaatgggtcatctatccgtccgttcctgagcaggtccgtatagaccgtgcccggcacttgggcatctatccatgcggtatcacccagacagcgcatctgccaggctgtctcctcttgtatatgcacctgttcctgactctgcccgaaagctgtgtcccgctgcggggtgccgctgcaggtatttaaactctgtattttcattatctgctccttctatactaaaatattggtatatttcgtcttcctttaaaataagcgccctgctcaatgatatgatacctctaaagtagacagattaaatacaaaaatctgttattttggaggtatttttcgtgtccagaaaaacaaagtttacgccagaagaaaaagaacaggccgttatagattatcttgatggaaataaatccagagcacagatatgtgcagaactaagcatatcttcaagaaccattcaggattgggctgcaatttataacaaacatggggttgccggctttttaaagaaaatacggaatagctcttattcgaaagaatttaaaaggaaagtggttgaggaatatataagaggcgagggctcgtctattgatttaggaataaaatatgatatttcttccggtcttttaagaagctggattaggatgtataatgccaatagagaacttaaggattacgatccgaaacaggaggtctatatggcagaagcacgaagaaaaacaacacttgaagaacggaaagaaattgttgagtattgtatcagtcacaatcgtgactataaaaatacagccgtaaaatttgatgtttcctatagtcagatctattcatgggtaaaaaagtatgacacgaatggagaaactggattaaccgataagagggggcgtcataaagcggatgatgaagtagaggaattagagcgcttaaggcgtgaaaatctacgattaaagcgtcaactagaagaaaaggatatggtagttgaactgttaaaaaaagtgaaagaattcgaaaggatgtgaggcttggaaaagtgcgccatgaatcaaaatatttggcaatcaagtattttcatacagaaaaaaactggagtattgaatggatgtgcaagcagctggaaatagcaagagcagcttattataagtggctccatcgagaagttcctaatgatgaactggaaaacatcaaccttgcagaactcatcaaggagtatgatgaacgtttcaatcacattttaggataccggagaatggcctcttggatcaatcatttcaaccatacaaaatatagtaaaaatagagttcacaggattatgaaaaaactgggaatccattcagttatacgaaaaaagaagaaaaaatatacatatgctaaggttgatgaaacggcagaaaatatacttcaaagggattttaatgcagctgtgcccaatcaaaagtgggctactgatgtgacagaatttaaggtaccaggagaaaagaagaagttatatttaagtgccattatagacttgtatgacagatatcctgtagcatatgttgtcagtgccagaaatgataatcgattagtatttaaaacatttgataaagcaattgctgcaaatccatctgccagaccaatttttcattcagaccgaggcttccaatacacgagcaaaatgtttaaaaagaaactagaaaaacaggaaatggaacagtctatgtcacgggttggacattgtattgataacggaccaacagaaggtttttggggtataatcaaaacggaaatgtatcaaatgtatgatataacagacgaagcaacattaagatatgccatcaaggagtatatgcatttttatagtgaagaacgtcctcaagacagatatgactgtaaaacaccactagaggtacggcaagaagcgctgacatcagatataccaatagagtatcctattccagaaaacaaacgaataaacaaatataaagagaaatggtgtgcatagaaaaagcctacacttcaattcgaaatgtaggcatcatctacactttattttagatatttcatctgtctacttgacaaggggcatatcacaatgtaagcgggcgcttatttttcttttctgtcatgtcttcagatcatttatctgcctttgggtactctgtgcagaggaggcggtacggctgttcatcctcctcgatctcagggaatcttccgatcggctcatagaaacggttgtcgttttcatcgtcattacacatggagacttcacctaaaagcacagccccggttcccggctccagttcaaaatcatggtacataaaaggataaactgttatgctctcaccgggctgcagcttcacctgtgttcctgcgggaaccgtaaattccctgccgtcgcagtttaccgtcacatccgtatccgcaaactggccgtcctctgtggagttgtagacacggatcagcacattgccgccgcctctgttgataatgtcctccatcttatcccagtgaaaatgcataggcgccatctggccttctttgatatagagaagcttttccgcatatgtctttgtgtatttgtcattcttcaagttgccgtttcgcagtgtaatcagggaaaaaccaacctcatcgaatttccccagaccataatccgtaatgtcccatcccaacatgttatcccggatctcatcgtactcatggcctttctgctcccaatcctccggtgtaaaactgcagaatggaggaagggcaaaacagtgtttccggatcatggcttccatttcttttaaagccgcattaatcttagatcttttcatggttctgcttggtcctttctggtccctgcgcttctgccggccttgttacggcacaggcaggcagcgcgggggtatggctgtttttattttgtagctttccactcgtcaatctgtttctgcatctcatcgatgacatcctggacgcctgttgcctccagtttttcctgaagcttcggcagatactcgtcagggtccacgcttcctgtatacagggattttccaaactcatccagcacgtttctgaagcctgccacctgggtactcaccggttccagattaaagtcaaatccgaaggaaggggcttctttggatgcatcgttgaattctttgaacgtatcccatttatcaaggggttcgttttccagaacgtatgtgttgaataatccgccctgtacccaatatggcactgcatagtctttctttgtgaccggatccaattttacttttgtgtcgtaaatgtaatctttaccctctgctgctgccttttcctctgctgtaggttcagcctttgtccaatgaacgccttcaataccgtaattcaaaaggtttctcaaatattcatctgtattgaccagattcaggaattccattgccttttccggatgcgcggagtttttattgatagctgtcatagcgccgcgggcggatgcattggtgatctgagtctccatgataggactggaaaccacttcataccctaagtccttgccccagatcagatctgcgtaaggctgtccgtcgccttttgtcacaaaacgtttgatagacttgtcgtctgttgctgttgcggcatctttgttgatatagccggcctcataatattttctcatggttttcagagtggatttcatcctgtctgtctcaaacacatttttaacggtcagggtgtcatcgccgtattcaataccgataggatcctggatcttatccatataggtaggagctgagtaatcttttgtgagatagaacggaaccacctccggttcattctccttgatcaccttaagccagggttccagatcctcaagtgtctggatctcctcatagggaatgttgtatttgtccacatactcttttgtgaatacccatgtagggcagcttccgatctctttttcactgggcacgccgtatgtcaccccgcctacctttgccgcttcccagaagcgttcatcaatggcgtcatacatgtctttgccttcttccttcagaaggtcatccagttccagaaaagcgcctttgttggcattctgaaggtaatcatttgaccaggaacaggtaaagcacatatcccattcgtctcctgtgttgatgacaacctgcattttctggttgtaatcaccccaagccacattgtttactttgatctttacgccgattttttcttctgtgtattcgtttacctttttgataacgtcaggctcgtctttttgcgcatcgcctacctgataccagacaagttcaacaacttcctctcccttttcatttgtctctgccttcttgccgcagccggacagcattcccgcagtcattgccgctgccagggaaactgccagggcgcgttttacagttctatatttcattctattctcctcctcaaatatttcacttttattgtttcttacaatccttactctttcactgcgccgatggtcagaccatttacaaaataccgctggaagaatgggtacgcaaagatgatcggcagcgttgagataacaacgatcgccatcttaatggtctctttcggcatgttctgtgctatctgaagtccattgacacccatcatggccttgttgctcgccagccagtcaatggagctttctatcttgatcagcagatactgaagtggtatgagattctggctgtctatatacatcatagcattaaaccagtcattccagtagcccaatgtaaggaaaagtccgatggtcgccagtcccggcatagccatggggataacgatcttgaaaaacagcctccactcggaagcgccgtcgatcttggctgattccactacagaatccggtatggtggtcttaaagaaggttctgagtacaatgacattaaaggtattcagacacaggggcaggataagcgcccatatggtgtccttcagcatcagcacttttgttacaaccaggtaattggcaaccataccgccggaaaacagcatgggtatggtgatcactgtggtaaaaaatttcttgaatgcataggtttttctggacagcgcataggcataggtaccggtaagaaacagaccgataatagttcctgcaattgtgaccagaatggtgacgccgtagctgcgcagaatattctccccggcgcttacaatataatgataagcatagaggctgagtttctccggtacaaactggtaaccgtttatagccagagtctgctcatctgtcagtgaaatgataatgacaaagataaagggcagaatactaatcagtgacatgactgccaaaacagcgttcaggaccacgtttgtgggctttttgaccttgttgtattcacaggtctcagactcgatcttctctatcatttttgcttttttacgttcttctctttttgaagacattctccttacctcctagtataataatggtgtagtcaagaatgactactggttaatagttacaaagtccaatctaataaatctatatagatataacggaaggaggagttccccctccatcagaagttataaagtaacattatttaccatgtctgaggtttccttaatgcaccagacaaaagatagaggtataatcactggaggcaggatcattgacgacacctccttgggaaccggccttccggctggtgaaacctcttagaaagtctgtcagtccattcggtggtgatttatgttttggctggttgggaagccccaggctaatacctgtataaaccgctaggttgtgtatccaccttttggaaatggatgcctgccagaaaggataaaaccatgaaatacccaaaagtacttatgatgcttgaaagcatcccttatctctcagtcgggcttgatgtcggtgcagacttcacctggatgtccatcatgctgcccaatggcattctcaccgggaaaccttttaagatcattcattctgatccgcagtcccgtgagcttgctgtcgcaaaaataaaggaagcacaagagatgtattccctcgaaagccgctgcttccttgagtccaccgggatctaccacatcccgctcctgtacttccttcgtgataaggggtttgactgctcagtcattaatcctatcatcactaagaatagcacaaatatgaacgtaaggaaactgcataatgataaatttgattcaaaaaaagctgccaaagtcggcctggatgcttcccttaagacttccatcataccagatgatgaggtcattgacctgcgcaacctggtacgggactactattacttcaaagacctgcagtccgctgtcgtcctgaagctcacggcggaactgaaagtgtcctttcctgcataccggaaggtgtttagcaaggtcactacccaaacttccttaaagcttctggaagcttacccccttgccgcagacatgcttgccgccccaaaagacatacttgtggaaaccatacgcaaaaccgcacgtttcggtgaaaaatatgccgtttccaaatatgatgccatacgtgctgccgcaaaggacgccgctgttttcggacgtgcgcttcaaagcagtgcactccggatccgactgtatatcaaaacctaccgggaataccaggagcatctggacaatatacttgaggacctgcataaggctgttgataagctggaagggacgccggtttatgaccgtatcttccttctccagtccctacgtggtgtcggttttctcagtgcagccgtcctgatcgctgaaatgggctcctttgacctgttttcttccccaaagaagctttatgcttacttcggcttggatcctgccgtgaagcaatccggcaagttcaatggggataaagtccacatgtccaagaggggttctagccttgccaggcgtatcctgcatatggtggctatcaataatcttaaggtggataaagggacaaaaacaccagtaaatccagttatccacggctattataccgacaaatgcaaaagcaagaagaaaaacgtggctgtcggggctgtcatgcataaaatctgcaatatcatttttgccatgctccgggataataaaccatttgagatcatcactcctcaggaacactgtgagcggtatctggcagcgcatcccgacaagatacagaacgcagcctaacaggtttatcatgaattttaaagatttccacatgggtgggcttattaaagttacccttttttacatcaactgcttgaaaaaaacttttttaacatttttcattttacctattgacatttcttagctggacttcctagaataatgcgttttcactgtcaactctggctaccagtttgttggcgatcatgataagtataaatcctaccgtagactggaacagcgctgccgcggaactcattcccagctcaccgttcgtcttcagtgcacggaagatataagtgtcaagtacattggtaaccggatacagcggaccggaatcctgaggaagctgatagaacaggccgaaatctgatttgaagattcctcctactgccatgatcagcagtatggtgatgaccggttttaaaagcggcagggtaatgtacttgatctgctgccatttgcttgccccgtcaaggactgctgcctcataatatgttttgttgataccgcagatggatgctagatatacgacagtgttgtagccgatgcctttccactgactcatgaagatgataatgaagggccacatggatttctccgtataccaggaaatcccgtcaatcccaaagtgtgcaagtacagagttaaaataacctttttccgggtttaagaatgcgaatatacagtagctgacaactacccaggacaggaagtagggcagaaacatggagctttgatagattttagccatgcccttgttgcgaagttcatttagcattaatgccacaataaccgggagcacgacaccaagaatgatgaatgcagcattgtataaaaccgtgtttctcaaaatgatccatgcgtcaccgctggagaacaaaaacttaaagttgtcaaagcctacgaattcactggtcagcaggcttgtgaaaaaattactgcctgtcaaacggaatttcttgaaagctaccaggataccgaacagcggcaaatacgcaaataggaaaaaccacgcagttcccggaaggctcagcagcaacagttctttgtttgttttgacacgggtgaagaagcctatcttttcttttttcttcttctgtttcaattgaatacctccctctcatcccgtcaaaatccctgccggccgggggttttggcgttctgttttgtatatatttactatacatggaagataggggaaattatagttgagaaattgtaggttttctggatgaattctagacaaaggagtggaaaaattagtgtcaactggagaaattctagggtatgtttgaaattaatgaaatacagacaggttccatgccatattcatgattttaatggaattttaatagaatttgttttgacaggcgaacgacgggcattcgcctgcagatattttgatttgtttagaattgatataacattgaacagttttgcgcatttactgcgttgaccgcattaaatgccgtattcctgatacagcttttcaagcagattgggattcgaggctgcttctatgagttccttttctctgccgtccccggacagctttaaggctaattctttaatgcgttttctctcaatttccctgccttccctgaaggcttccaactcccgttttttcagcagttcttccatctgcatatacctcacccccaaattccgatttttcttcatttctttgattttgctgtggatttcctgaatggtttcattctctgactctgccgcacatgtatctgtactgttttctatgtacttcagtaaatggataagtttttcggaaacgctctcctgatttttcccttttgtgtttagaaagattttctgtacctgatcacctaaagacaattccgtttccaggcatttgttttcaaacgtataccggtacagcccttttccgaaaggatcgaaagtacagataaagataataaagcacggtctcagatcattaaaatcttcccccggcttcagggatgtgatatccatctctccctgataatagcggcttcgttttgcaagattatgctcatcttcattctgcatctctatattgtactctacctgtacttcgtcgcttgcatatatatccagtctcacacttctgaaatcagagctgtacaaaatcgtatgctctgcatggactcttacttttgtgatcggacgaccgagtattgtctccagtatcagacggcatattgcctcatcttccagcgctgctgcaaataaaaacggatcacatagatccagttcctcaaatttcttccttgccatgtgattcctcctgcgggaatatgacacggaagatacctgtctgtaatatgattatagcccggggactttaaaaaagcaactctattctttgcaaatatccgtttaattttacttgccagttactatttttcccgggcacagcgggcacctggtgaaaaggcggcaagattccctgccttttagaagatttccacccggactttgcagtcagtgaaattaaaacggaagcgcaccgcagcattgtctttctccaccgtaaaggttcccttgttggaacttccgcttctgggatatccgtcgccgcagtaggtagccgacagtgttccatacgtggagaccgcaaaatcatatgtacccccatagggaatcagcacgctcagtgtgtatgtattatttcctatataatacatcctggtcacttcactgttggaatcatttttcacagctcccacataaggctgaaagcttccgtaaactactaccttttcggggagcttgatccctgtctccgggtcatagactgcttccgctccgtatttgatctgaagctccgggttggcagccagttctctcaggcggtgtccttcctgccaaagccgttttactgtatcctcctggccgaatcccatggggcaggcgggactttttttattgatctgataaaatttctggatatcccggtctcctccgttcccccgctccatagtcaccggcgcatcgcccagcatacgccgaaagggaatctcaaaaaaaccgcacgcgttgttcacttccagccagcggtatgtatattccagaaaatgattcctctcttcaaagttctgatgggcaaaccaggcaatctggtcatatccccaccagtccttaaaggccagctcttccctggaataccgggccgggtcctccaccaccagaccgccccagttgtcgtattccatcagatagggcattgcctgtgccgaccagccgttgggattgacgccgccctcactgaatccttcccggacaagcaccaattccgtaccctcacgttccaaaagaggcatccgggtaaatggcatggcgtgataatcaaacagcagctttcccctccgattcaccccatgggtgtgggcatccataagaaccttatgccgtctgccatggacggcagcatacctgcgtatcatctcgaaaagctcctgagtcttcaccatgcccctgtcatttgccgtatacagatgcacctgccccatatggagcgcttcataaccgcagtcgatatagcgcgctgcccggtaataaaaccacattctggcctcctgccggttcagatcaggaattcctccattcttctccggctcctctctgtgactcacaaatcccgccggttccccgggaaacaaagtatctgccagacaaaagcatctgtcctccggctccattccaaaatcgcggaacacgaactccggtatcttcactgtctctatcctctctgtcacccattcaaaaatacatgattgcaggataatctccgggtccacttcatgaactctttctgccagtgccgcagactttgcaaaatgcacctcatcgtcctcggtcatataccagattccggaggcacgtcccaggaattttactcccaattcccctatcacccgcaggtcatccgtcagcgtcccgctctcaaaaagtcctgccgctgtcactgcccgcgacagataattctccaggacctccttggaaatcctgccgtcaaatctataatccatcctctcagtttcccttctctaaaaatgtgacgattgtcgcaatattggcccctgtagcgccatctgccatcctctcgtccttttcccgcatcacacttgggccaacggcatccagatggagccattctaccccttcccggataaaagattccaggaagcaagcagccacactggctcctgcccctttttcgggggcataattagccagatccgcagtgctgctccaggcaagcagctcccggtaatggctgcccaaaggcagtctccataccagttctcccgcttcacccgcagcatctataaaatcactgctcatacgctcatcattggaaaacattcccgtgacccggtcccccagcgcattatggcaggagtatgtcagggtagccagatccacgatccgcccggctccctgctgctgggcatatgccagcgcatccgccaatataagacgcccctctgcgtccgtgttgtagatttccactgtggtgccgtccagcatggtgatcacatctcccatccggcaggcctgcgggccgatggcgttctccgccagaggcagaactgccataaggttttctttcgtatcctcccgtacaagaatctcaaaggcctccagtacattggccgcaccgcacatatcaaacttcattccctccatggatttcatagactttaaatgatatccgccgctgtcaaagagaatacccttgcccaccaaagctgtaaatgcctgtcccggaacgcattccctgatgaggagcgccatttttgctccacgggcactgccctggttcaccgccaagattcctccgaatccctgctcctttagatccatatggtccagtatcctgcaggatactcccagtttcccagccagattcctgatatacccggcaaattcctctgttcccaggtaatttgccggaagattgcccaagcttctggcataggcaatacattttccttccagctccccgtatcggactgcgcgtataagcccgctgtcctctgccgcgtcactttctatataaaataccgcatttccaaaatcctgcaggatctcacgcattccgaatatatcctcttttttgagttccttcattccctctttccgtaaactgtaggcaccctgatagagagaacgcaccatgacacgcaccatctgtatctgcgtctccgcctttaaaggcagcgaagcagtgccgtccccgtccagccgtatcagaaagcatccctcccgctgtcttcccagccggcagaattgttctgccagccggcaggcatccatactctccggaatcacttctgtacagacagcggtatccgctcctccgggcacaaccccttccggacatttcagaattatcttcataacacaagatccccgctttccgtcctctgaccattctctacacgcagaagcagtgttttgatctcatagggtttcaggtatacacggatcccggatgagctccagggactctccggttcctccatgagattgcactcgcaccattcctttacttcaaaaccggggcatatctcaacttctccccgcctcccttggaattcatggaatctgagcacaatctcctctccgttttccgcctgcttcagcgcgtctgccatgaggttctccctgttccaggacaaaaggctcccctgcaaaactgcggtgcccgctttcgcactgataggtgagttcagatcaaacgcctcctgttctatccccgcgtcataccactcccggcagtgaggcagcagcgaataggtaaacgtatgactgcccaaatcagcactgtaatccggatctgtagcagactttaaaagtgtcaggcgaattgtgttttctttcaggtcataaccgtatttgcagtcattgagcagcgcggctccgtatcctgtctcccagatatccgcccatttgtgggctgccacctcaaattttgcggcctcccagcttgtatttcttgtgatcgggcgccggatattgccgttctggatatcaaatctggcatccacagcccggatatccacaggaaatgccgccttcatcaccttctgccgctccctccagtccacagaggtcttgaaatcaatccgctttttgctgttgtagaggcacatggtctgactgatggtactcttattgtatttccaggtaaatgacacctcaatgcccagcccgtgtctccggatccggatgtccgtacattcggtaatctcctccatctttctgtcaatagtaggctcaagttcccaggcgtcaaagcaacgcggtttgtcctcaaagatctgcagtacattggcacaggcaccccgggacagcatctctctttctgcctccctgtcataaactcctgtgagctgccctttttcattccagcttatcctgtaaaaaggagtcgagacttctcctcctgccccatcctgctgctgtgggcagatattttcccctgtaggctgccggaaagtctcttcttcagactgcagagcaggctcccacacaatttccgtataagagaaaggtttcatatcccggacaagcacataagctccatcctctttccacacacagggaaggggcgtctcagcactgcatccatctccctttctcaggcaaaatccgcctttgccgtaatccccggcacacacagactccgcctctttccggggaatccggaccacagaggttctcagccagccgccgctgttaaatacggaaaacacccgctccttactgcattcccggacgagagcagcgccggaggcctcatttacttctcttaaaagggacgcggccttttcatattccgtatggctgtcaagatagacctccctaatggacgaccccggcaggatatcgtggaactgctggcagagtacgatcttccaggcacgcaggatccgttcagaatcatagggaacgcccccaaatactctggctaacacggagcatatctccgtatccctcagcccgtattccattctgcggttcatccgtttattatatgcctgggaagtataagtccctctgtggaactccagataaagctccccgtcccacaccggaagatacccttccatggggttttctctcagcgtggcattgagaccgcggaaatactccgtcacggactggttttttacatgggggattcccggcatcttctcaaccatttctatctggcgtatcatatcccggtttggtccccctccaccgtctccatagccgtaagagatcagtaattcccggttggtatccttgttcttataattgtcccagacacttttcactgccctggggccggaatttccgttgtatgtataataatcctccccgggatcggaggtggtcacaaaatgggttgtcaccccggttccgtcaatgcccttccaggtaaaggtgtcatagggcaggcggtttgtgtcattccagcttatcttggtcgtcataaaggtagttacgccagatttctttaaaatctggggaagtgcccaggaatacccaaacacatccggcagccaaagaaattcactttcatagccgaattcttttcggaagaaatttttccccaccaggatctgccggatcatggattcccctgaggcgatattgcagtcacactccacccacatggccccggatggctcccattttccccccttgaccctctttttgatcttctcataaatatcggggtggtcctccttaataaattcatagagctggggctgggactgcagaaagtgatattccggatatttctccatcaggcggtccaccgttgaaaatgacctggcagctttctctctggtatggcacaaccgccacagccaggctacatctatatgggtatggcctgccatggtcacatggacatccggttttccgcggccgtccagacacccattcaggtatccggctgcctctgacacgctttcataaaagccccggctgcccggttccgtataatctaccaggcagtaagcctttacaagcatatttaagatccactctcggtattcattctccgcactcaaagcttcataggtctcaagagccgctgtggtcagataatagaggtcatccgtaccctgatccagcactccgatctgtgccctgcatatctccatcacattgtcttttgggattccgcctccgctgagtcctgtccacagcctgaatttgagcttcagtctctgcccacaaacctccggggaaaagaacacttccttgtggtttccgtccacagcctgataaggctcatcgtttacatagagcaggctttcaaaatttccgttattcccggttcccgcgggagcgccaaagtcaaaaaggcccagcacttcctccccacaaaattcctgggggatttccacctctgttgtcagccagtaatatttatcccagccacggaatgaaaatcccaccccgacctccccggcactcaccctgctctttctgtcgctgtcctcccagaacagaaaagaagggatatcctgaagcttccgataccgaagctcgcgcagttcctctgccagattcttaatcctgtcaaaatcatgaaaatcaaacggcattttttactcctttccaaacaatcccccataggctttgtcataggcctccagcagttccccggccaaagaccaggagttcaccagcggatgaagcataagtgcctgggccgcatactcataagagcctttcctcacagcctccactgtaagacactcataatttttgatcagccgcatcaggatatcacactggcggggcacccggaccgcaggtaccgggcagatcccctctgatgagacgcggcaggtcacttccaccacatcactgtctgccaatcccggaatacatccctggttttccacagagagcaccaggtattttccctctttgctctgcatcccctcgatacagtccagcatcacacccgcatatcccataccgtcaggaacctccaggctgcccttctccgcagtgggacgtttggctgcccctgattcgatactcatgtaagaattctctctcagctgcatgtaatacaggaatacctgaagtgctccctcggggtccgcatctatgtccatgcttttcagttcctccatcatgcgcctgttgatctcctcgatcgtctcgcctctggcggcacctgccctctggatattggccagtgccttctctctgtggtagtaataatacagatactcatttggcagaagttccattagacgcagaagcttgggatcgaacatggcaaattcctggatctctcccagaaagctgtcgtctgccagaagtttcggaaggatctcttccccctctttcttcacgctccttatccaggacagatggttcagtccgaaaaactccacatacagatcctcctcctttactcccagccaggccgccattcggtactttatgctgctgggcgcatcgcagatccctatcacccggtcatagcctgctgaccggagcgcctgggtcacaagcccggacggattggtaaaattaaagatccatgcgtccggggcatacttttctatcattctgcagtattccaaaagcaccgggatcgtgcgcactgccatggaaaatcccccaactcctgtggtctcctggccgatgacaccgtgttccagagcaatcttctcatccatcacacgggaatgatccccgcccacacgaagggttgtcaccacatagtcagcaccctcaagagcctcccggggcgtttttgccgcccacaccttcagatcttcctgtttccgctccaccacatgacaacacagccgttcgatgatcctctgtttttcctcctggatatcgtaaagcaccacctcgtctatatgcagctttttatatctctttaaaagtccgttgataaatatgacggttctcacacctgcaccgcctatgactgcaatcttcatattgatctcctttcgcttatagctgttcactcttcactttctcattttcacgacccttggcaaaacgaagcagttccttttcttccggaaaaccggtatttcccccatgtgcagacacggagaaggcaccgcagatgttaccgtactgcagacatttttcaacggcttcccctttcagaaaaccgtagatatatccggcattgaaggaatcacctgcaccggtggtgtccacagcctctacccggtaagacggtctgtggtacaccacaccgtcttttactgcaagggaacctttttttcccagcttgatcactgtctgtccgcactcccgggcaaaccgaacggctgcctcttccggcgagtctgtctttccatagtgttccgcctctgtctcattcataaaaaggacatcgatccacggaaacagctcatagatcctgctgctccagcttccggtagggtcccatcccacatcaaaggagacggtggcccctgtctcccttttcacccggcgcagcagccgtgcataggaatcatggcattcctccccctcataacccgtcacgtgaatatgccgtgcccggcctgctttttctatcttcaccctgtccatacttaactcagcattagtacctctgtaagtgagaaaggaccggtcatgggcattggtaaagctcaaagagatccctgtccgctcgtccttcccggtcacaagcagttctgtatccacgcctgcgctttcaaaggtctcccggatcatatgaccgtaacagccatcccctactgccccctggaagaccggatgaagccccagtttaccaagtcccaatgtaaacagggccgccccgcctcccacataagtctccatagagtagacaagctcctcctgtcccggcgcgggaagcttctccactccgggaatgataatgtccgcatttacgtctccatagacatagacatcccatttcttttcactcattttctctgctccttttgtcttcatctgcgcagcacaactgctgcccggcaggtaaaaaaccggctttcagtgcgaactaaaagccggttttctgtcaacccttcactgccccgatcatagcgccctgcgcaaaatatttctgcacaaagggatatacacacaggattggaactgtagtgatcaccactgctgccatcttcagggaatctgatgtgacagctgttgcattctgggccagcgcctgagccacagaggtaatatcctgctgagaactcatggccttgctcagcatctgctgaagtacggtctgtaccggccacttggaggtatcactcatgtagaacgctccggcaaaccagtcattccagtgatttaccgccgtataaagtcccaccaccgcgatcacaggtttacttaaggggagcatgatacgcgaataaatctgaaaatagctgcatccgtccagctttgccgattcctccagactgtccggaatcccctcaaagaaggtcctggccatcagaagatacgtcacgctcaccagggagggcaccacataaacccaaaaactgttgagcagatgcaggttcttatactggatataagtagggatcatacctccgctgaacagcatggtaaatgtgatcagcatggtgatcagcttatttcccggcaaatccttctgtttcagggaaaatgccgccagagtagtcaccatcaggcttagcacggtgccgatgaccgtcctggcaactgtatatccgtaagcccggatgataccgccgtcccggaacacttccttaatattgtcaaacgtgggcactctgggccagaaccagataccgccccgggcggcatcctttccgtcattgaatgccagtaccaatacattcagacagggcagtataatgatcagacagacagcaatgactatcatatatacaatagcctgcacaataatgtctgtccggctgctcttgatcttgcttttttggcctttactcatccttaacaccctctctcacctgtcaatgataaaagttgacagcattcttatccttgttatagacatccgccacataatcctcaaacttctccacgcctgctgcctttagctgaccgcggaaggattcaatgatattcttcacctcgtcatcagactttgcaaaacatgcctggacaaatacttcatcccagttgagcagatccatctgtgtcttgacatcttccattccctctgaggacagatacgccggcgcgtccagtcccgggatcagttttttcacataggggtaatcctttgcgacttcaacacttctggcaaaggtatcgttggaggacgccccaggccttgcctcaccgaaattgttgatattgtctttgttggtgagcacaaattcaaagaaataatttccgcttccgccgaagccggcgcccacatcattgagtaagtagtccatatttccgtcacttaaagcctgctgcacatcttctttgagaacaggttttccgtcaaccatatcgtagcttacgccctcaaccccgtactgggcgatcatctgcccctcttttgtggagagccagtcaaagaaccggaagatttcctcaggattttccgccttagaagaaatcgccatacatcctctggcactcttgccgtgtgtcacttttttgttgtcaccctggatgtcattgagaggccccagggggatccagtcatctgtctggtagataatatctgtataattgttcacgtcagcgatgatcgcagagttataactcttgcaggcctcctgggcacgggtggaatccatggtgaaaaattccggattcatgagaccttcgtctataagcttacggatataattgatctcatcatagatggaatccctctccgcctcgtgcttcacttttccgtccgtgtcaatattgtagttcttgctcacgccccagcggtatcccggacagatatactccagggtatccacagagccgccccagtatttcggtcccagcggatagaccggatttccgttcttgtctttaaatccgccttccttgatcttcacaagcaggttatagaaatcatcctgtgtcctgatgtcattcacatcaatgcccaactgatccacaatagatttctgtatgtacataccgccccggtaatcctcctcggggttgtactgcagagacttgtccgtagcatctacattcatctgccacagatacacgccgtcgaggtcatcccggaaggtgacattcttataggaatcccagggaaggtagccgtcctcataatatctggaatatacttttgaattcttcatataatcagatacatccgcaaacattccctcttttgcagcctttgacagaagcgggaactccggtcttgtagagttgtccagataggagatgatcacatccggaatggtgccggaggccagttgtgaggctagcactttcgcgtcgctgtcaccgggagtatatttaacatccagcttgatccctgtcagctccgtgatctttttcatcgtaggggtatcgtttaaatccttgggaagggaatttccaatgtcatccacatatgcctgtaccgtgatggtgcggtctgcgatccaggtgtccggttttccttctttactctctgcacttacatttttggctgtctctttttcatttcctccgcagccggccaaagcaccggctgtcatggcaccgcacagagccagcgccagaattgtttttgctgcttttcgcttcatacctcatcctcctttaatttctctgatcacactaccaaagtcccacatctgtgatcttcttacatatcttattgctgatcacaaccagtatcaatcccacgactccctgtataagcccgatcgccgtggcatatccaaactggcccccctgcagtcctacccggaccacatatacatccagcgtatcagccagcgtcatattgccgggtgtacgcaaaagccagatttgatccacgcctgaggagagcagacctccgatgcccatgatgaacagcagacctatggttcccctgatccccggcagtgtaatgtgccacatttttttcagctttccgcacccgtccatctcagccgcctcatacagagctgtatccacactgctgatcgccgccagatagatgatggaatcccatccaatatttctccacaggtccatggaaaacaaaatcttcaggaaatacttggcgtccatcataaagaatgtgccgccgtctcctcccatgcctgctatgatctggttcagtataccggtatccggcgcaagaatcctctggagcattgtgacgatgataaccgatgacaggaaatgaggcagatatgtaatggtctgcgtcaccttcttaaacttcatgttcctgatctcgttgagcatcagtgccaggataatagcgaacgggaactccagcacacatttgataaatccgatcctgaatgtattcaagatcagtctgggggcgtcatagctttcaaaaaaggttttgaaatacttaagccccacccagggacttccccagatacccttgttaaaagagtaatccttgaaagccagcacagaaccggccatgggtacgtagcagatcagcgcgtaatagatgagcgccggcagcagcatcacatacagaggccagtagcggacgagccgctttcccagtggctgctttggccgcttttctttctttttctttcccaaactttttaccgcttgcatttggtatcctccttccttctgttgtctattatatttttttccgccaaatttccacaatggataaaaattagttatttcatggacatttctcttctctgtcgggctcacactccagcactgcacagatgggataatggtcagacagccagactttcccgtccctgtcctcccatttttcaacattttggcatacaaagggcctgccggcaaaaatatgatcgatccgctccggtgtgtcctcaggctcgaatccgtggtaagtgatcccaatgccctctgtgacatttgtaaaatcgctgcatctctcaaggactgcaagctccggactgtccggctctgcgttaaaatccccggccaggatcacaggaatccccggaaatgccggttcccggtccgctcttttcaatataagctccagccccagccttctggcttccccgccaagatggtccagatgaatgttatacagccggaacagatattcttttcccggattcccgatatatgaaaacacagctccggtacagaccctagggcagatgctctggcaatcgtaacggcttcccggcacatggggctcccccgacagccagaaggtatccatggagatcagattcactgtgtccctccggtacgccacagacacctgctcatcccccagtttttcatccctgccgcatccgatcacataatatccctccagattttctttcagccacactgccacatggggaaggacctcctgaaaacagatgacatccggctgttccttccggatctttgctgcgatcaattttttgcggcttgaaaaacaattttctttgtcctgtccgaaatcacatcgtatattaaaagtaaccagtttcatgcattttcctcccgaagctttttataaaagccagagccagaccggctgggaccaggctttttcccctgctgcgttcttcaccacaaggcgcacatattcctcatccccgttcagcacaaaggttccgctgtttaacttcccttcgtcatcgtgaagatgtccgcttctgtggggtgtcttaaagtaaatgtccgtgcagccgctgcaggaggcatggacaatattgtcctccacataaaagtcatagatcagtgggccggtggaggcataaaagcttccgtccctcaatgcctcaaaaatccccctgtgggtaagttcccgagcctttgccatgatgaacccgcctatgcagtgcggtcccagttcatgggtatcatcacacgcaaagcaaaaggttctgttcctcacgaacagaaaatggtcataataggtctcggaattaccgttgctgtcctcaaactctgccacgtggttgtagatttccattcccagcagaccatggatattcttgatatccgtagaatccacttttgaccagtaggggtgggcatatatggtgacattgccgtgcgctgccatatattcaatgatcctctggggggtacacaaggtattgcctgtcctctccctctcaaagcggtaatcatccggaatccggttcgtctcaggcaggcctatgcttacaagatgatgatccttgcgctcaggcagctccagatccagttctgtgcccggaaatacgagaaaatcctctcggttcaactcctcatgcaccccatagatccagtggtctgtaatggccaggaaggaatatccctcctccctgtaccttttggcaatatcctgtggttcgctgtctccgtctgatcgggtggaatgagtgtggagattccccttataaaatttaccggactgatacaatgttctcttctgcatcttttatcctcttttctcaaaattctgcctccgaaaatcggcatgggcatattataaggcactttctctctgaaaaagaatgaagatatctcagaaaaataatggacaattctacgataaccttaaatctattgaatccgcattttatatgtagtatcatttacccaaattctatcaacacttttcaggaggagacatttatgcaattactttataaagccggaggaaccctgtccaaagattttatcggacagatttcctacaccgtatgcctggatcgaaaatacgaagagctggacatcgaattttcttttgataaacaaaaatacacagccgcggacgtgacagaagacatggtcagggagctgacagactattgccgcagcaattatggcctggaactgcctcccggcgctgacccggtagcggaaatcgttgagaatgccaagaccgagatccatacactggcaatgctcaatgacaaattcatgggctgcgttcaccgtcagctcaccaacagacacatgcacttttgctcctcctctgccacagagggctgtctgcctcagccggatcttgagggagtcctcaaagtgaccatactcgtcttcaatgtgctcatggacgatacaaattacacactgcaggtatctgccagataaggaggttatcatgtataaacgaatggaattacacaatcacactacagaatccgacgcgtccctcacatgtgaagatctgcttctatggatggaggcagaccaggtggacgcctttggccttactgaccataataccatatccggacaccccaagatgcagaaactgctttcaggacgcagctccggtatacaatgtatctacggcatggaatacaccacctattacggacatatcctctgcctgaacttaaaagagtatgtcccctgggaaaccattgaccgccgccgccctgagcttctgtttcaggctgtccgcaaaaagaacgctctggcaggcattgcccacccgttttcctatggctatccctttgcccgggggtgccgctttgagatggagcttactgattacagttgtgtggattttattgaaattttcaataatcctgaaccccttcaccaagtcaatgaaaaggggctgcttttctgggaagatctggtgctgaaaggctggcccattgccatgacctgcggtatggatctgcacggacgctgggaaatgggaggccagttcgcaacctttgttaacggagaaccgggaggagacgccgcctctgaactggaacaggccatccgcagccagaaaacctgtatctccaaaggccctgttctggagatttctatgactcctgacagccgcgcgctttcattccatttggctgacacaaaaaaacccagcttttcctgcccggatgcctcccagtacctgatcacactcaagaccgcagcggaaacctacaagacggcccctgaccggatattccccatagacagactaaatgacgcggaatatgtaattccaaaactatactataagaccacagagattgaaaacctggtctgtgtttcccctgttctgcattttacaaagcagaaccgcttgtccgggatgtgatgttatgaaatggaaaggtatttactcgcatcgcattttcacgcagcttgttgtctttactcttttgatcagtctgatccccaccttgtccatcacaagttttctgttctacaagctggagaacatggtcaagaccgaactttccaattcctacctgcagatgacctctcagtacataaaaaatattgatgaaaaactgacccagtatcaatacagcctggatgtgatcgcagacaatacggtgattctggaagctctggtggatcagacagaaagtccttacattaaaggggaacagatcagcagtgaggtgacaaaatccctgctcctggaccgtcagaaagagatccgcaactgtatgctttactctgatattgacgaataccccgtatacggaaaacgtgcttccatggtcaaggaggccggacatgaagaatggtttctgcaggaacgtgccataaaggagggcggctttagctatatctccagcgctggcaatgttcctgttctttcatttgtaaaaaacattgaagatgtgaacatccacaattatgaaaaaaagcagcttggctttctgaaactggatctgtatatggatctcatcttcaggcctgcagccacagctaatgaaggggattcctcctatgaggtcattgtcttcagtgatgacaacaagattctctattcctcagcacccggaaagaatttcctcttgaacgcatggcttggaagccaggatacttcagaattgatcgacggttttaccatcaaacaggagcatctgaacggatgttccctgaatgtacttcttctgtttgacagtcatcagctcaaggccaaacagcaggcggttagacaaatggtcctgcccatcatgctctgcgtcaccctgctcatactgttctggtcctggctctacagccggaacttttcagccagggttggctgcctggtacaaaaattccacacagcagagactggtgatctgaacatctacgggcctatagcaggcaatgatgagatagcagagctggaccggcagttttcccacatgcttggcaaactagattccctgatccagaaaaactacatccgggaacttgagaacaagaaagcacagttgaaaaacctgcagctacagatcaatccccatttcctttacaatacgctggaaaccatcagctccatggctgcagtgaaacaggtatttgacatctgtgatatctgtcaaaaactgggagagatcttccgctataatctcggaaagaactatggggaatttgtgactgttgcacaggaactgggccatgtacagaattatatctttatcataaaaaaacggtacggcaatcgttttgaggtattctataatatctctatagatacggacaacgccatgacactccgctttatccttcagcccatcgttgaaaatgccattctgcacggactggtgaagcagaccactacaggcaccctggagctttccgtctgggaggaggaggacagtctgatgatacgtgtggaggatgacggtgtgggcatggacatccagaaggttgaggaattgaaccgctccattcatgtagctgacaatctaacgaaaacaggacttaacattggtatccgcaatgtcaaccagaggatcaagcttgcctgcggagaccagtacggaattaccattaaaagcacccttcactatggcagccagtttgatatacgcctgccgctcattcggaaaggagaacaaacagatgaaaataaacctgctgatagcagatgatgaggagcttataagaaaaggcctgatcgcacgtcttagttatctggggtttgaattcggggagatactggaggcagaaaccggcactgaggcactggaggcagtcaggctgcatgatatatccattgccgtcacggatatcaggatgcctgatatggatgggcttgccttcatccgggaggccaagaagctctcccctcatctgcgtttcatggtgttaagcggttatgccgaatttgaatatgccaagactgcgctgaacctgggtgccagcgcttatctgctgaaacccctgtccaacaatgacctgaaggaagagatggagaaactcatcacacacgtagagcaggacaccagaatacgccgggatatgacctccagaaaaaagctggaggaaaagaacactgcatacacactggaaaaggaggtcaacgccctcctccatgagcctgggcgtgacagctccggaaatgacaaatatccggcattctatcatagaatctcctgcgccccggaaaaccgccttcttcttgggatcatcaacattgaggagaaaagctgtgagaacaacttctgcaaagatgacacggaattgatccgctttgcagtaaaaaatgtatttgacgagatccgctcccccggcaaggtacttctggtgaacagtatcatccacaggtaccagatgtacgctgtctttgagagcaggggtgaacacgcttctctccgcagggaggttgaacagttcttcctggagatgcgggctgtactggaaaagcagatgggtatttatctgaccatgggcaccagcagtcagacccacagactctcatcaggaatcttgggagaggctgaatccgcccttcgacagcggaccatctacggtgacggaaacctttacttctacgaagacaacactgtcttctccggaaaatcctttccctcctcggaattgtattttctggaacagtatctgatccagggtaatgtgaacagcatcctcaagctcctctcccaattgttctcagaggaaatgcttcaaagctgcggtgtctcctatgtccgtatcctttgggtgcgcatcctgaatcttctcctgaaatactacgagcctgagatacgcaagtatatcggtgtggaagaccttctgcacaacttccgggcgctggatgagctatgccttccccaaaaaatccacagctatatctcagagaccatctcagactgtatcagcaaacatggaatgcaggacgcaagttcaaaagataagattcagcttgctacccagtatatcaaaaaacactacaacgaaaatctctctataaacggcctggctgagctttacaacatgagtcccaactacttttcttctgtcttcaaaaaggaactggaccagtcagcagtgaactatatcacagaggtccgaatggaaaaagccagagagtacctaaaagacacggatctaagtgtgatcgagatcgcagaaaatgtaggctatgaggacagccagtattttttccgggtctttaaaaagacgaccggagtaacgcccctccagtaccgtcagcaatacaggcttgatacatccatgtagaaatatctacttcaaaatggtgatatatccatttctcctttttccgatctggtgtatattgaagagcgaaaaaagaaaaaaggggtatctctcatgaaaagatttcacaagcttgaaagtaataaaatggcattctgtctgttccttctgtgctggctggcctacttcacctcctatatcggacggctgaacttctcttccgccatgacagccatgatcgatgaacaggtacttgccggatcccaggcaggtttcatcagtatggtatatttcttcgcctatggcattgggcagatgtgcaacggactgctgggtgacaggtttcatcccggacgaatgatatttaccggactggctgctgccgctgccgccaatttccttatgggatttgtggattcctttttcctcatggccctaatctgggggatcaacggttatgcccagtctatgatctggcctcccatcatccggatttttgcggaaatgctgcaggaggcgcagaaggtgcgctactgtatccacattgtctcctcacaggtagccggaaccctgggggcctatctattggcggcggcagtcatgtggctggcaggctggaaagccgtgtttggcgctgcggccctctgtctgggccttatggcagcggtctggttctttggttttggccgtattgagcggtacagcctggaacacggaacagaggaaacaaagacctctgatgcttccgatcccacacctccaaacaccaaggccataccattttcctctcttttgttccgttctggcctgctggcagccatatttccggtgcttgtccacggaatgctgaaagacggcgtggccacatgggtgcctaccttcatcagcaaaacctttctgacttctccgtctctctctgtacttgtgacaacggttctacccatggtaaatctcacaggtgcatatgctgcacagtatgtataccgcagagcgggcagacgggccataaaagccgctgttccctttttcctgctggctgtagccgcactgaccggtatacgtctggcaggcagtctgtccattgtcctgactgtgatactgttcgcgcttatcactgcttccatgatggcggtcaataccctatttgtcaatctgctgcccttaaactatgaaaagcagggacgtgtctccactgtatccggatttctgaactctgtagcctatctcggcaccgcagtttccacctttttcatcggggttatggtagaccgtctgggctggaccgcaactgttacgagctggatcatagtgactgccgcggctcttctggtctgtatcataaaatctctgggtgaaaacaccctgtctaaaaacctttaaaaagctgaagtgccgcccggaaatctcccggcagcacttctttttttgtttttctaatattttttcatctcccgaagggaagccggtgataccccgtagcactgcttaaacttcctgtaaaaataactggtatccgtatatcccacttcctgggcaatgtcattgatcctgcggttggtattcaggatcaaatccttagcaattccattcttagtattgctcagatactgggtaaaggaacaccccacctctttctggaagatctgtcccagataagatgcgttcatatgatacttataggccagtgtcttcaggctcagttcctctttataattcttctgcacttccgtcatgatctgctttaccactggcgtatacgcagaattctccgcgtgcaggtatgtgatgatctccgaaatctctgagataaacatagttttcaggccaaagatatcctctgccccgtaaatcccctccaccatgtcggacagatcctgcatgttcttctcttccagcttatactcccctttgatatcccacaacagcatggcgatcttaagggcagtctgataaagattattcacatccgcgtccttgcgtatattattgatgaacagatcttcaatatagtcgatggccccgtccctgtccttctgcagtatcatcttacgcaactgtgcctcatcaatggccacatcctttgacccccggttcttaatgtggttatcgtccacgcagcttccgtatccgtccagcatccggtatttctgcatccgcatggcctcccggtatgcctctggaaggctgctgtgatcacgaaaagaagggccgatgctgataaatgtaaagatacccagttcactctccagacggttctgcagataggagaaacggctgtggatctccgccctgacttttctggcagtctccccctctccgccatcccaggtgtagtctgtctgaaagccttcgatcaagagcagggtgtctgccttcagatggatcactctgcactcttcctcctgcagaatggacagaagctcggacatatcgcccttgcgcatacttctgctgtcaatcttcatgaccgctgctgacaaaagctctgattttttcactttcggcaaaagcgcgagaaaggttttccgctcctcctccgatatccctccctccaaaaacttctgccatccgatgcgatcttccatattctttgctttatcccggtccatctcctgaagttttatgagtgcgttttttaccacggtctcaagctgcacctcgtcgataggttttaagatgtaatcctccacgtcaagctggatcgcttttctggcatattcaaattcatcatagcctgtgagaatgacaaaccgcactctctcgtccctgcttctgatctcctttaagagattcagtccgttcatcacaggcatctccacatctgtcaccaccaggtccacaggctccttctcccacagggacagtgcctcttttccgttgtgtgccatatggaccacgtcaagtcccagtttctcccagtctattatgttccttattccctgaaggatcagctcctcgtcctccaccagcattactctcttcatctgtttccctctctttgacttttaccttcaatatcacatgcattccccggggatgatttgccgttaagaacacaccgcaggtatcaccgtaggctgctttcagcctgcggttcacattggtcaccccaatggatttgcgggtatccatctcattattggcaagctcacggttcttgctctccatatccttctcaggcattccccttccattgtcttctacatggataaataaatcctcccctgcgcgtctcgcataaatattgatctcattgtcattctcctccatacggatcccatggatgaaataattctcgataataggctgcaggatgaatttaatgaccggaatattggaaagttccggcccgcactccacactggagtggaatttcccctgataacggtattcaaacaattccaagtatttcttacagtaatgcatctcctgcatgagagttatcacatctgcttcctttagctggcttcggaatgtgactgccaggctgtagagcattttccccacctccctgtccccgttgcagatggctttcatgcggatggcctccagggtattgtacagaaaatgcggattgatctggctctgcaaagcctgcatctccgcgttctgctgttcgatctccgccagatagcttttcctgatatacgattccagctcctgacacatgagattaaaatgccgggagatcatatccagctcgtctccgtgttcattttctgggagctgcaccttcagatttcctgtctgcacctggttcatcccttggagaattccgtccagtctcccgctgagtctcttcagatagctgcttatgagaatctccccggcaatgaccagggcaatccccattcccagtatagccagaatatgaactgcagggatggatgcggctgtgtgcttatccagcctggtggccactatgtaatcctccacactctggatctgtatgtatgacttgagcttcttacctgcgtcctcctgctgaaaatcatctaaaagcagagaattttcaccggggtatacctgattaccgtttttgtagtacaagtatagctccgccatgggatatttttcctgaagctctgtcatctctcccgtgtcaaacgtaaagatgatgcatccttctactctcatgctgagagggtccctgatctccttctgaaaagaataggaaccagcggatgccagtcctccatccaaaatttcttttctccgctctcttccgttgtcattcacgcgtatatcattttcagaataaaaaactgttgtcttgttattgttatagctgataaattctatttttttgatattgggataggcggagtacgcattttccacatagctgtagatgtccttgttgtccagggtattggaggaggcatatgtgtccagatgacgcctgagatactcctctgtatcataccggaaataattgagcaggtcctgcagctctgaactgttttgataaaccgctctgtgcaggtaatccgcgtccgagcttgcgcgactcacctccagaaccgcttcgccgcaaagctttcctgcataatcctggtttgtctccagaagtcgggttctgctggatgaaataaaaaataaaatgagcactccgacgatgaggatcagaactgccgaatagctcagaaaaagtttatgaaataaatgtctcgggtttttgttttccatgaatttcctccttttataagtataacataatccggtatacctgtgaaataaaagaatccatggaaaagaaaaagagagttacgaataactctctctcttcacagtgcgtctgggcggggacttgaataaaatctgctgctgtaccttctgatttcatctgccgcaatctcattgcgcccttgtgttttcaaagcaaataatgcaatatagctgcctcccggcgccatttcatctaaggtttttctaactgacgcacggatattttcctcagagactgtcaaaccatccatatactgggtatcgaatccaccgatatagcacattttatacccgtttttcttttttagttcagccggatgattggatatatgcatggtattggatgctgtacaccccatatctgctatctcatccagaatcggtgcaaaatatccgcagcagtgatgctcatacaacacccccattgaggtaaccatatcaatgatccgctgcagatggggtttcagcaatacccgccaggtgtccggggacataaacattccttttccgtgcccatagtcatcgtgcatacataaaatatcaggtttatagtatttgatgatatactcatacatccgtattttatgatccgccacagctccgaaaaaatcataacaggcttccggctcttctatgagcgcacagagtgcttcctgaaaatccatgacactgaacatcctctcccatgggccaaacacatcattgatccttgtcagtttatgtacacggtcccagtccttcgtgtcagcagccgcatgtccctcccaatccaacctcgataaatccgggaatttcatatagtccttccacactgtaatatccggtaccaaatgtatccccggtgttggattagccgccttgatcttaggctcataagtccagctctgcccaaaccagtcctttgccacacccggaacatttgtatattcgcatacaaaatccattcccaaaggcgtataggtctgaacatctgtaatcataggcagaaattccggctccttatgctgcagggcaagcagcgtattctctttgtaggataaaactgccatttactatcccttcctttccggctcactgtccactgtaaaacatacggctgtatcggtacatctcgtcatccagatccacatctcccctgactggcctcatgtcacggatccgataagcgcatcttcctttttttcctctggtctcgatcatttttcggataatctgtaccgcctgttcatcggtaatatcgccgctgatgttaaaattccccagctgaatcaaactgttcccatacagttccatgatttcatctttatctgtagctccttcctgtccttcccaggcatcaaagcccgcttcgataaagttcggtatatgcatacgcacatctccgcacgaatgcagagcaatatacattccctcctcatgcactgcctgcgtcagcttcttatattgcggaataaacaactcctggtagatttccccggaaaagaacggagcacgctgtgatcccatatcatcatgaaacaaaatcatgtccgcatgataatatttttttgcaatctttatcagttgaatataccagtcaatcaatctgtcaaaaaatgcagttaatgcatccggttcttccagaagatagcagaaggtatcctcaaaatttgtcaaatctgctgttctttcaaaaatcccattatacaccacaaagtaagtaaacctgtcattcggcagcatgctgtaaagctcttctgcatccttttcccaatccaattcattcagatcaggaaataccaattcattctcccagtttacaatatcggacagcctgcgggtacctggttttaccatggcagctttggtaagcggctcatactgccactctaccccaaaccagtcaatccctccaaaggcccttgcggctgcgtcaggcatcatatctggacagattagattcatatcccgattcatattcggcagccacaaaggtttctctccacaaaacacacgaagcacattctctcttggtgtaatgggggtagaaagcctgggctgttccacacttgccgatccataacttcccggtattttataagaaccaattcgtttcatctccgattctgaaaattttacaatactcatacactttctccttattatctgtaatttaatccatgcagaaccactcttaactctttcctacaatctgttctgtaaatacgcatgtctgctgaatagctgctagacataaaacaaaagcacaacagcgattgccgcgattcctccactgatcacaggtattaaatttctctttacgcaggtaagaatatttacatttgtagctgacgcgatgtaaagagaagctcctgccaccggtgtgaccgcagacccaagtgcacatccgatcaaccccaaatgaagcagcggaagcggtgcaagcccggtggatgtaatgatagtcgtcattaccggtataataagactgacattgccattgaatactccagtcactccaactacaaaaatccccagaagagtggtgatggatatggcaatggctgttcctcccccaataccggacagcccgtccacaatcaatttcattccgccgataccactcagggcagatgcaaaaagtgtaccaaaaaccagcagaataccggggcctttaaaataatcacccatgccgttaaacaccacggaaacatcattaaaacattctctgaaatttcttctgcagattgtgtgtaccaccactgcgagaagcaggctgaaatagcaggctgccaccacacttatgacaatacttcccacgatcagttcactgaatatcaatatggtcaccaagggcaccagcggcagcaaagcataaaaatatggaacgcctatgtctcgtatagattgagattccatgacctcttcggaaacctctgcgtgttccctcttatcaaaaaactttgaaaccggtataaatactgccataacaactaaaaggacaaccagcatgaccggtatctggctggaaacaaaccactccgagacagatacatcttctatacctgccagagacaatgccgtgtacagacttgcatcagaaggtccccagaccgtcacatatgaaagcaataccgcagacgcgctggtagtctttgagcatcccaccttgaggagaacgggataaagcgtggcgatcattagtgcagcaacactgataccgcttggaatcactatctttatcagattacctactaaaatcatcatagctgccagcagatagggcgccttgatacgcttcagaggagcagcgatcatagtagcaaacatatctgaggctttgatatgtttcatatagacaatgtatccgtatatagacatgatgatcaatacattgcctcccattgtcccctgcgcactggtattgagcttttcaaaaatatcgaaaaacgcactgccgcaggtggcttcccccattacatccattcctgccagtgtaagccccgcatatgcagcaagagacagcgcgagcagtgtcacaactgtattatacttcttcacaatgctgaaaataagcagagccaaaaggactgcagttgctaaaattttaatcatttccgtatcctccttaacttttataatctaattgtatagggaaaagaacatttttactattcccccgcaggttcaaaaaaagcctttgccttttatgcatggagactataagctttgtgaacaatagcagataaccggaagcactgaaagtatacattctaaagtgtggattattttttattactgtgctataataaagcaacccaagacccatgttttttcacaggagttgaattcggatgacaaacacaacactattactaaatatgcagatcctctccgattatctggatgatcagttttctgattatgtcttttatcgaagcaatgatcccatggttctggaggatgtacgtctctattacggacaaactactgtttccgaacacatggtctatgttgcagctcctgaatatcttgacatcctggtaaaaaagaattgcaacataatactcgtaggacaggctgtcattcacacagatcccatccattttaaaaagtccattatccacattcccagaaaagaaaatccctgtcttattttagaattgatacaggatatctttctgaagttccggaaatggtctgctaatttggaccagattcttaccagccatgggaacatgtatgacctttgttctgcctctactgagatttttgagaatccgatctatattctggaccacaataacaatgctattgtacgcactgcattcgtggttggaatgatggagatgaaaatggatcctgccaccggaaacctcttcctccctgtggagagaaggaatctgctgtatcactcaaaagaattccttgaaacctatcagacacagactgcccaatactggattcctccctggaacaagcacagagatatctacataaatatttttgatgaaaacaaccgttatcaggggcgaattctgatcaatgaactgcagtcttcctttaaggccagccatctgaagctactggaatatttctcctgttttataaaggaggcttttttgtcttgtcattcaatagaaaaacccaaagacagtcctctgcaaaagcttctgtatcagtatttatttaatgaggatatcaatgaagaatatatgctggaacagcttgaccgtatcgggtggcatcaggaagacggatatctcatagctaaagcatccatgcctcagcaggattccagctatgcttacagtgcctgtctggatattacggaaaatatcagcgattgtgtggcattctttcgtgaattagagctgtatgcaatatgtcatctgccgaaaaccatacacaacccgacacactgttactctattctccatgagatcgggttaaaaggcagtattcattttggagccagcaatcttttttataatatcctgaagctccccaattacagcaggcaggctcaggccgggcttgaatacggtctgtggctgcatccggatcaatattgtcatcccttttcaaagattgccctgtcttatatgttaaagaattctataggggacttaaatctaaatatggtatgtgcatccagtattcgtatactggaaaaaattgaccaggaaaaaggcagtgattattttaatactctgagagaatatatccgttctaactgtcagcccgtattggcagccaaggccttatttctgcatagaggcacacttacctaccgtttaaataaaatacaggagctgacagacttgaatctggatgacagagatactatcttatacctggatctatcttttcgtatacaggatttattccgacaggaggcctccggttcccggaaaatacctgatacctgaatctcttacaattgttcctctgcgctacagcggccagagaaacggaatcatcacaatacagacaacaaagcacactgccaccagcggaagcccctgtctcagccagtctcccgtaaatatacctccttcctccgccagcatggggtaagacggtgctgcaatgggcagggcaaacccgcagctggaagcaatcatagctgtcagcatgacaggtttcagattcacacctaggcttgacgataaaaccaaaacaaagggcagaaccacaccaaaggtgcctgtattatttaaaaactgggtaatcaaaaccaccagcaaaaatacggcggcgatcagcactctgtcaggaatgtcatcccagaacagtccggcagcattttccgacagtagggcgtccagccccaccttctcaattcctgttcccaatgccttaattcccataatgaacatcaagatatcccaccgtatggcattgacaatctcatttactgaaagaatccctgttcctcccaaaaacagaataactgcacagccggctgcataagaggagatcaaagacttctgatcaggagccactgcaagaataaagaacaaaaaagtcagggctacaagtatctgattttttctgcttacagcactttttacgaccggctgcacatccgtacacccggctctgtccggcagataacgctttcctataaagcaataatataaaatcatcagaattcccgccggcacggtcacaagggagatctcaaagatacctattgtctctcccggtacagcattttcgtaagccgcctttcctatcatgttcagaggagttcccatgaccgtcatcatccccccaatggttgccgcataggcaattgccatcatagattttgtcttactcaccttcaggctgcttcccagagtaagtaccagtgacatcatggcaacctgcactgcaaggctggacaagatactggacaaagctgctgtacacagacagagaaccagcagtatcaccccatcgttggttactctctttaatcttttctgcatccagttccccaaaacgtctgaaagccctactctaaaaaatgcttcgctgagtacaaaagctcccacgaaaataaacatagatttatcggcaagtcccgaaaatgcctctgaaggggtgataatgcctgaaacagaaagcacacaggggatcatcaggccaatccatccaagtcctgcctttcttgtgagcagcaatgctatcagcaataccataatccctacaataaatatctgttccgcatttcccatttttctcccgcctttcctgcgcttttctgtcaccaaatcatctgcatatataaacctactgtaacggctcagccccctcacagaatcgcctatggaaatgagatttttgcttggctgctgaatcactacaacgtcattatagtcttgtataattttaagataattatagcatttactacagtttgcgtatattcagcgagtattataaaaaaagcagtctgattttacacatcaggctgaaaaagaaaaaaagacacggtttcccgtgcctttcaaaaatcaagatcaactttcttccaatgcatgcagaaccttccggttcataaacgcaattaggaaaccatacagacttcccataaataatacagcggtacctgctttcagttcaaacagcatcaggatcacacccagagagactatgcttcccaatgtgcacacaggcctggtcagaagaagtaacagagacgttttgacaatgtccctgtttttcatccgatagcgggacgccagcaaatacaggttcggtgtcaccaccagggctgccgcaaacaatatgacaaacaggatcatcagaggaaagacaggaatctgtaccgcaaaaaactcaatgtttatctcaaataccaggatcaggaacatatggccagccgccagaagatatttctggccgcagtcatctgtataggctttcctgtaatctctccaggcccccgtctccgtcctggagagcagacggttcatggtgtaaaacagagccgaaagcgccggtcccataggaaccatacacaaaagaaacagaggaaggcaggtgcgcacctgggatactcccacaaaaaggaaaaacaggagtgccggcaagttggagaatagaaataaaatattcgtaccgatcacataccacagtttttcgcaaaaacccaatatcttatccatctgaaacacttcactaaacattttttcctcctttatgggtatacacatcatccgacatacatatcatccggtgcacacactgcaatttttataatgatatcaaaaccgtcttgatctcatacggatgcagatgaagcttcatctcccctgtggtcactgcctcagtaaggggacgctctcttaaatccccctccatccaacaggaatacccaaatcccggtttcacagtcacgttctgggaacttcccgcaaattcatggaaacgcagaacaatataatttccatcctcagattttttcactgcgtctatttccacctgctcattgtcaaaagtgacaaagctttcaaaatccacctttgtctttccagccgaaactttcatgggatcattcagcgcacatgcctcctgcaccgtatgtccctctacaaaatccccgccgtgaggcagtaaggcgtatgtaaaggtatgcataccctgatcctgtaaatggtcaggctgcagaccggaacgtaaaagggaaatgcggataacattatccttgatatcatgtccgtatttgcagtcattcagaatgctgactccgtaatttctctcggaaaggtctgcaaaccgatgggcaacgctctcaaatctggcctgatcccagcttgtattccagtggttgggccgcctcacattgccgtactgcacatcataggtcgcataagtggaacggatatcaacagggaaggccgccttcagaagctgctgtctctcacggaagtccacatctgtcttaaaatcaatcctcctggaatcccgatacatgctcatatcctgtgagatcatggatttcatgtacttccattccatatggatcgtcagcttcagaggtccgcactctgtcacctcaaatgctgtcagctctgtgatctccctcattttctgctgatagtaaatatcaatatcccatgcatcgttgtcaagaggcttatcctcaaacatctgcaggacatttcccctctccccttctgccaaaacttcacggtcaaaggtcctgtcataaagtctggttatctggccgtaatcattaagggacactagatagtaaggtgtctcaatctctcttccacggatcacaaagctgttctgctcttcatttccctgtgcctgaggatggaaacagataactttatgtcccatggagggcacctgttttgcctctacatatactgcgttttctcctttttgtacgggaagcacgcagccctcctcatctgtaaagtacccgtcatctgtacagggaactgacaccagttcatcctttgtccatgcagaggcgttccataccgtccaggtattctcttcctgcagagctgtgttatctgtgaaatcattctccacctgaactgctatgctctctatctgggcgtagtccttgtgacagtcctcataaacttcatggatagaggagccgggaataatatcgtggaactggttggtcagtatcagtttccatccttttgtcagactttcctgatctgctttttccaggcttttctccatcagcccctgcataaccgtcatccactcagcacggcggtacagaagctccatttttctgttcatgcgtttattgtatccctggcttgtgtatgttcccctgtggtattccagatacagctccccatcccaggtgttcacatactggtctgtgttttttaccgtctctttcagttttttgaaatattcccctgctgtggatgtctttacattgggcagtcccgggatcttatccagtctgcgtctctgttccagcatatcacggtttacaccgccgccgccatctccgaatccgtaggcgataagcaggtctttgttcatctccttctcactgtaggcatcccatacgccttttacggtctttggcatcagcttgccgttgtaggtgtagaaccaggagccaggctcgttccagggttctggtgtggtgatgaaatgtgtcaaaacttcgctgccgtcaatacctttccacttaaaagtatcgtgtggcatacggttgaactggttccagcttatctttgtggtcataaacatatctatgccggattttttcaggatctggggaagtgcccaggagtagccgaacacatccggcagccagagatactccacatccttaccaaattcatccttgataaatttacttccgatcaatatctggcgtgtcagggattccccgcttgtgagattgcagtctgcctccacccacatggcaccgtctgcctcccagcgtccctctttgacaagctctttgagcttcccatatatttcagggaagtcttcttttatatactcgtaaatctgaggctgtgtctgcaggaaaatgtactccgggaacatttccatcaggcggagcacagtggaaaaggaacgtgaagctttctcgtgtgtatgtttcagtctccacagccatgccatatcaatatgcgtatgtcccacacagtgcacattcaccagggaatgcttatccatccggtcaattttctcattcagcacccggtcagcctgatggactgattcatagaattcatcacttcctggatatgcccagtcaatacaatgacaggcttcatccagggcatttctcagatcatagcggacagggtcgttttcatttaggttctcaatggtttccagcaccatggtccccagatagtaaaagtcatccacttcctcatccagccaggccaggtctgctcttttgatctggtgctcctgcactgccggtacaccgccgccctccaatcctgaccagaggcggaaagtaaggctggtctctttcccggtgcacgcttccgggaaaaacacttcctgatggtttacatccacgccctgaaaaggttcctcattcagataacacatggactcaaacccgctgttattgcctgccccagtgttgccgaaatcaaaaacaccaactactcttttgccggcccactcagccggaatacggatatccctgtgcatccacagatacctgtctctgcctgcccagttctctccctgggcaatccttccccatccgtcaaagtttacgggaacctggggattcactgccttctgttcatcctcacacatgaggaaatctcctatgggagtcacgccgcggtatctgtatttcttcacttcatccattcgtctctgtaattttctgtctgttaaaaacataataccctcctgtttgcctttctgcttttattttacctgttttgccggaaataacaattttcctttttctatgtttcctgcacaaattctaggttgttcagaggcaggggggaatatttccactctcatcgttttacccggtatcccagatagtccagcatcagttcactgtacatggcatttgcccaggaaaaccattttcttgtgaaaatctcagggttatccacaaagaccccctcatgcatcataccttttccaccatctgtccccacaagacgcctgagtacacccagcttttcctcctctttttctgcggtcaggccttccatggccacagcaatgtgccatacatatctagaaggtgtgtgagggcttccaataccggacagcttatcccctttataatagtagggattggcctcgctcaaaagaaatcttcttgtgttctccgccacatcacggcgtcttggtatgtatcccagatattccatggacaaaagactcgggacattggcatcatccatgagattatactgtccgaatccatcggtctcgtaggcgtaaatctccccaaattctcctgtcctgacaattccgtatgtctcgatccccacggttatctcctcccgcagccgttccgctctctgcgctgccgcttcctcatgaaggatttcccggcatatccctgccatgtatcccaggatgacacaggcgaacatgttggatgggatcagatatccataggtacaggcatcatcactggggcggaatcctgaccagataagaccgcatccctcttttacaagagcgccttttccgctccttgacagggtatccgtgtaaatgcaatccttccgctggaaacggtactgcgaactggactcatggtactgctcccgctcaaacacatccataatggttttgatccctgtcaggaaagtatcatcaaaatgttttgtatatcccgtattcttccagagaagataagcaagctggacgggatagcacagggaatccacctcgaatttcatctcccatacccacgggttctggtcaggaaaatctttctcccaacagtttccgttgtctgtctcgttaaatgcattggcataaggttctctcaaaatacattgaaactgtctcttcacaagacccgcgatgacctgggtcagcttctcatccttcttagcagccagcagataagggcgaagctgtgcagtggaatcgcgcagccacatggccggtatatctcctgtgatcacatgggttgtcccatcttccatctcttttactgtggtattcagcgtgttggtaaaacaattgcgaaacacctctgccagatatggctcttctttgcatttttgttctgcttctttgatcagttcttcaataattccgggattttccatgataaagtcctcctgtaggtttttatgtaatttctcatgtgttcatcctatcaaaaacagaggatgctgtatagtgaaatatctctcgaaaattgtaaacttttctattctctgttattactgtattatgaatttcaggatactttttcacatacaaaagagtctccggacttctaaagtatatctgtccatgagactcttatagatttaattgctgttataaattatagatatccaattccttaacagcacaaaaatgttttttagtatttctgtcataagtcagtgctgcagcaagaaccttaccggcggtcttcttctcaccagtcaaatccttaaaccgaagtgcatattttttctcccggatctgctctaatgcagtttcaggtgctgcatcaatcttcagctccaaaatcagcgctgtatcacagggatcataaggataaaatataaaatcagcgaaaccctttccggctctgtcctcacgttccatacgataactgtccctggcagataaataaatcagattaaccaatgctcccaggtccgactcactgttataatttaatatggggacttccgtatcatgtgccagtgctaaaatctcctccatagtcttgacatctccgcgcaaagtagcccgcagcatttcctgtgaacgctttgcaagcttagcgatatatcccatctccctgcgctgcagaacttcttcgtatttcagcatcaactctttatttggaatagctatttttccatctttatgtgtcagcataccatataccagcattgctgaaaaaatatcttcgcggctgtgcagctccattgtttccgccgtaaaattcttaatacatacctcaatccactctcctgccaccatacgcacgatatcctctttgacttcgtgcagattgtgattgatgtagaaaaatatttcatcgtacggtcctgtactggtccaataggtgcccagatgattctctgacaatgctctgttcacagaacgaggattatataccggctctccttctgctgtctgatacccatcataccaaattttcagttcctgaaaactaaatgccgtattatctgttttagcagaatacttttgatataaatccatcacttctctgtccgtaaaaccgaaacaagtgctgaatctggcaattcccgtgtccgccatggtatattcattaaacatattcagcggagaaccgcttgaatacttcgcgatcgggagaatccctgtcatatatgccatctctacataggcctgtgacttgagtaaattctgcagaaaacgcaaaaatttaaaatggtcattctcgtcaaatgttttgtcatggaaaataaaatcccactcatctatgacaaaaataaaccgctctcctgttttacctctgatcatctcaagagcgtcccagggtgtatctgtatcggtgatcccgcactggggatactgctctgccaagtctctcataagttttttcactacagcactcatataggtattataatcttcacataaaaacggcatcttgctaaagtcaataaatataacattatgtttattaatatgttcttcaaaaacaggactgtctttgatcttcaatccggaaaacaattccctgctgttacatccccgtgaaaagaaggaggatataagatttgctgccgcggtttttccaaaccgccttggccttgtaatacaaataaaacggttttctgtgttaaggacagggaataattcttcaagaatttctgatttatccacaaagtattccatctgtgcaatatatttataagcctcgtaacacacgttattatttaaataatatcccatactgccctcctgatttctttacaaattagttttctgcactttctgtaaacatatagtcctgctgaagcacaaaataaactctgttattagattataacacattggcagattataaaacacccggcagttctggctgatcccataactgccgggtatttctctatctcttctgacatttctcacaaaaatatatattcccgcccatatacgcggctctttttatctctcctccacaccgcatgcacggctgatgtagagaatttttggagagctgggtaatataccctcccttgtttccgaacagatcacgttccgtatctcttcctcctccgtcacacatctgccgcagtgtacctgtcacagaatcgtaaaggctccggaaatcttcctcctccgcttcccgcatgtcaaacctggggtctatccctgcgttccaaaggatgtcctgcaggacaccattacccaggccgggtatgcgctgctctgttgccaggtaggttttggccgatatctttttcccggtatcagggtagaggcttcggaaatactcgtatgtgaactcttcatccagcgctgtatatttactgatggaggaacggtagtattcttcgccgcactcccccaaaggatacacgccgataaacgcatacatctgaaccgatacagaaagtgccgtgccgtcatcaaaccctatgaataactgatgctttttcggaaactctgtcttttcctcataatatcttggataagcgccgtctgacaggatgatcatgcagctctctgtgtcaatctcgatcataccgccccggttcaccgcttttatgacggactgcccctggagcatttcatcatattcctctttgtcctcacgaaagaacgcaaacttatggggcgtatatcctgctttcacataatcaatggtctttccggccaggttctctgttatctgctttgctatagtccggctctccggcagttccagcataattcctttcctcctttaagcctgcttccacctcttcagtgttgggaaccaggactccatcatctttctggcttcctcctgggtaccgaatggatttccgttttcctcgttgaatttcaggttgaatcggatcatatcctccattgtcatattgtcggtaaattccccttccttataacagtaacagcaatagtcctcatttctgcccccgtcactgtttgtaccgaagtctccgtccttttccattggcataccgcagctctgacaaaattttttatcttccataatatatgttcctcctgtttttcttacaggatactatatgtaatatgacaccctatgtcatatatcgtaaagtttccggattttttcagcttctttttttatatgcgctttcagccattccggttccagaactcttgcgtctgccccaaaggataatataaatccggtcagccatctgcccggtgtgaatgccgcttttacctcaaatcccccgtcctccagacggacaatatcttcctccgcaaaaaaatccagcacctgaaatccggctgcctctgtgaatctcagcttcaaagctgtcatttccgcaggcttttcctctttctgctcacagacttccgcggcttttctcatggagaactcctcccgctccatctgcagctcccggatacggttcagacggaacaatcggaatccctgctttttcctacagtagccggacacataccagtggccgcccttaaaagtaagccttaccggttccacggtccttctgctcttgatgccagaggaattataatactgaaaagtcagcagcctgccgtgcagaatggcggacttacagagttcaaaatactccttctcctgctttcccgcgccccaggtctcaaaatccacttccagccagtccacggtctgtctgccgaatagtccggcaagctgtgagagaagtctgctgctatcccccgccccaaccgcgtccagactttgcagagcggtcatgatatgctcctgttcgtcctccccaagcagcgtcctgtcaagctgaaactgctccatgagccgtattccgcctccgtgtcccttctctgtatagaccggtatgcctgcggcggatagtgtatccaaatcccggtatatggtacggacagacacctccagcctttcagccagtgccccggctgttgtctcacggtgttccattaatatgtacaatatttcaaataacctgctgttcttcatctctccatcctgtctgtgccatattctctgtctgtgccatatcctctgtctgcgtcatattctctgtccctgtcaccttttgactacgacgaaaggcagtcttagcggattacgctgcagccggcagcacacttccgaatgcacagatatggagcaatctgctccatatcgcgccggcagctcttccgtaacagggcaagtcctgcgtttttcttcctttagtataacacaggcccgattcagcccacaagatttgttctcacgtcattatgaaaaactggatcagacttgccagggtctttccaatggctatagacaacactaccagccctacaccctttgtaaggccaactcgccttgccataatagcaaatacattcaccacttcaccgagagctatgatccagcttcccaggaacatgccgaaaaatataccgatgactgccagtccccattgtccgaaaggcaggtggaactgatacagataaaaaatatttcccagaaaagtacccaggatcagagcgtcctcgtagaggagaagattgtggcctgtatgggtaacgcctgcataccgggggatgatccccagtccgataataaaggccgccagcgcggtagccacaaccataccgccgcttaaacctatgatggcagcaaccagttcataaaaccacatttcagtttttctccttcctgttcttcttctctatcagagttttatccacatcatcctcatagacacgcatctgaacttccataggcgtgggatcctgcgtgatcttcccatgcccgaaatggttgaagaaaaatatcacgccgagaccgattccaagagaatacgtgaactccagaatggtgtgtcctgtggaaatattgcctgtgagctgtttgtagatctgaaaaaacagcccggatgtgtccacatccatattaaatgtcataatggaaaaagctccgccgaaaaatgtaagaaaacacaccagcacggtctttgcccaactccagacaacgtgtttatgcttctgtgtctcataggtaatgacaatgttcgtctcccccatatgcgtcacatccacggtctgctctttatcctgaaccgcctccaccagctccagggcagatatcacataacgccccggctttccgtccggaatggtgaatacttttcttacccggttcctgttcagtacgcttgtactgctggaggacagctttgccacatcctgcagatagacctccggctgatgtacctccacatttttctccgtctgcacatataaaatatcactcatgtaaacatctcctttaaacgtggacagccggacgaaatcttcctgactgccgtaactattacagggatagtatgacatgttcctgtgcaaactatacgccaaaaagcacacttgcagtgccgcagttcaaatcttctcccgcaggcggttcagtatttttttctcaagcctggacacctgaacctgggatatccccagctctcccgcaatctgtgtctgggttttttcctggaagaaacgcatgtagatcaattttctctcctccggatccaatgtgcccagcatctgttccagcatcatgcggtttaaaaggtgctcctggtcatttctctgttcctcaatcttgtcttcaagggaaatatccgtgccgtctccctgataaatggtcttctgcagggactctatctgtgcccctgactccatagccatcaccagttcctcccgggttaccgcaatacgctccgcgatctcctccatctccggttctttcccgttttccatcatcagttcctctctggctgtgtaagcccggcagcatatttcctttaaggagcggctgaccttcatcatgccgtcatctcttaaaaagcgtttgatttcccccgtgatcatgggtactgcatacgtggagaatttcacatcataagaagtgtcaaatttatcaatggcctttaaaagaccgatacttcctatctgaaacagatcctctgcctccacaccccggttcagaaaacgccttacaatgctgtgtaccagaccaatatttttctctaccagcgtatctcttgcttccttatctccctggtgcgcacgcccgataagggcaaggatatcctccatacagcctccttctactcaaagacctgacttccggttccgatttttttcttcatccggacgacagtaccctttcccggttctgattctacttccagcatatccataaatgcctccataaaggcaaagcccatgcctgaacggtcctgctccggctttgtggtaaacatgggttccatagcccgctccacattctcaattccccgcccgtggtcagtcactgccacggtcagctctctgccgcggatgatgcagtctatcctgatcttctctgtctccttctcataagcatgtacaatacagtttgtgatcgcctcggagacagcagtcttaatatccgccacctcctcaagtgtgggatttaactgggtggcaaatgctgccaccgtgatccgtgccagcccttcgttgcaggaacggctgtccatctccaatgtcatttcattggtattctccatatctaccttcccccttaccttcttttctggtgccagacagcttcctggctgatttcaatatatttgtagatccctgacagtcgcatgatcctgttcactctgtcattcacatggatcgctgacactctgcccccgctgtaatgcagaaggcggtatcttcccataagcatgccaatcccggaactgtccataaaggtcgtaccggaaaaatcaaagacaagctgacggacatttcccttcttcagttccttgtccacctcatcggttatctgcgtggcaaaatggtggtccagctcctggggcacataaaccataagacaactgcccctcttttttaacacatcttccatactcatttccccttactatttcaatttatcccatccggatactgatatccgcagaaatcccatattttcccgcggacaacaaaaggatgtgcatacactcatgcacaccctttccttcaaggtttctcttaggttattcttccccggtgtcctcccagccatcctggttgtcaccgccatcaccgtattcgtcgccgttattgtcgtccccgttgttgtcatcctggttatcatctgtgtatccgggatctgtaccgccttcgccgccgtcatcctggcctgttgtatcttcctgaggctgtccttcatcagcgggcgctgaaccgtctccgccgttttcctgccctgctgacgtctgcgttggcgttccacctatggctgccatataatccttggcatcactggcatagctggtacccggaaatgcatctatgatcttctgataccatacaatagcattggcattgtcaccgctcttctgataagactgggccagatagaacatggagtcatagtccggttctcctatatcctgtgccttcagcagattatcaatggcagaagcataatcctgattttcatacgcagtgatacctgcgctcttatacccggccttcacagtttccccgatgtcattcatgatcgtatcatacatggacttggcatccacagagagcagggacgcatccacgctctccagcgcattggctgcattctgatagctgccgctgttgtatgcctgccatgctttgatcagattatcatagctctctgacttggtgttcgcctgggcgatctgctcattggccgtgtttacagactgggaggaggcatcgatctcctgctgcatcctgtctatctccgcggcctgggtagctaccttgtcactgtattccacgatttttttgttggcctcattattgatcttctgtgtcttggcaggaacaatgaggaaccaaagcgcagatgcacctacaagcagtccgatgatcagattgatcagcgtgttggtcacagttctctccctgtattccgggggctgtatgatggtgtcattgcccgagttatagatcacccggccgtccttttcctcacggttcttttcctttgccttgaatctcggctccagactggtcattcttcccgtctggtcatccacctcccgcaggaaacgcagtgtggtggtattggtcttatcaatcttcgcggcaattttcagctgttttctggccttctcatacgcgccttcctttatatagatcagagagagcagatgatagcccttgatcagcttagggttgctggtaagcacttttttcaactgcatcttcgccatatccaaattaccggtacggcagtattcgagacactggttatatttcttaatactggtgttgatggtgtctaaccggttggcattgctctgcagcttattgatgtagtctgacgccacattgccgtccggcataatattcttgctgatgacccattcacttaaagccgctacaacctccccggtctcaaaataaaccagccccagaagatttcttgcctggatattgcatttgttcatcttcaggcttcgtttcaggcaggtaattgccccggacaagtcacggatctgtgccttctccagcccctgattataatagagattggacagagccactgcctttttctgggcggtcacattacacccgcactttgggcagtaaggtgaagtgttgagctgtgcttggcatatcatacaattcatctgtcttctccctaattcttagccgttccattggtttctttcagcatttccttcaaaatatcgatcacatccgttaaatcctgcttgtaaatgttgccttccgcatcatccacgtccaggcacggctgaaatttcttcagttcttcctcgtaattaatcattcattctcctccttacgtaatcctttatctccccggcaagatacaaggaacccacaacaaacatcaggccgtcccccttcagggcgtatgccttctcaaacgcctcccccgaatccggcactgccagaacattgccgcatccgtttgccctgaaaagctctgccagctcttctgctgactgcttcctgctgccccatatctctgttgtcaccacattggcaaatttaagtccgctgcagactctgtgtatcatatcctcatagtccttatccgataccgtggcaaaaagaagcgttatggaatattcctcctgaaaataccggaccgtctctacaaactgggcgatcccatcctcattatgggcaccgtccacgatcactcccggaagtatggtctccattcggccctgccatctggtatgctccaaccctttttttaaggtttccttctctatcttatggatgcctttgaggacgcccatagtctccactgccattgaggcattcatcatctggtattttgcgataaatggaacaaacagctctgtagtcccgtaaactgccgaatcaaaggtgaaaccgatcccctttggcgtataagacaaaagcttctgactctcagcctttacctggtggcatgggcatccaagctcctctgcgcgcctgcggataacagcagcggctgtctcgttattggcatcgaagatgaccggcacgcctttcttgataatgcctgccttctcgccggctatcttgtcaatggtatctcccagatattccacatggtccaggctgatggatgtaatgacgcaggccattgggttcaaaatggagttggtcgcatcaagccttccgccaagaccggtctccaatacaacaatgtcaacatcctcatcctcgaatatcagcattcccatgagaaacaaaaactcaaaataggtaggatggtaatccccctgctccacaagacggtcggaaagctccttgaccttcagaaaggcctccagaaatttttcatctgagaccatctgctcattgatctgaaatctctcattgatcttcatcagatggggggatgtaaaaagaccgcatctgtaaccgccttcctccagcatggtggacagaaaagcgcagacgcttccctttccgttagttcctgccacatggatcatctttctatttttatcgggactgcccagcatgtccaggcatttcctggtgtgttccagtttatttttctttgtgaatttaggaatttcttcaatgtatgctgctgctttttcataagtaaacaaaagcgttttccttctttctgtctttggtaagctttcgtaacagttcagacaggctgaactgttgcaagccttatctatataggaaagtcaccacttcgccttataaagacaagactgtctgctgcagtccggacagtagctgccggattgtaacaggtcacttatcattataatgaagtggtgacaatatgcaagcaaattatgtcggttcttttaaaagtttttaattctgtaccgggttttccgtgtttggcacctcaatgggactttctccggcccctgtccccgtaccgttttcctccccaataggatttgcggcggcatcgtcccctatacctgctgcattggggtcaatctctcctgtgccttctgtattctcaccttctaaaggcggcacctccggggccagcggctccacaggtaccttgtagatcatgctgtcagttctggtgagcaccttgcgggtggagctgttgcttcggatcgccacgtccacctcatccccgtcttttaactccacatccgtgagcagaagagttgtgggactgatatatgtggcatccagaagttctccgttcacctccacatatgcggactgggtaaagttttcccctgtgatataatacctaccgtcagaaatcttttcgattttttcaagcacagcgtcttttacacccaggtgcatctctgtccgggcaaagggattctccccgtcatagacatactgcttcccataaaggatatcatactggagcgtctccagatccacctgatagtttttcgtctgccgtctggcctgatggaaacggaagatatttccctcgtggatccccacccggtccatgacctctgccgccatctggtaggcggccacattggcgtcctttttctcaagacccatattgtcccagatcacatattctgtctggaacagataacggttcttcacatcctttaccttcagtcccatggttggaagatggtctccgtacatgacaaggaccacatcctcatcatacttggacagcgtttccgtaagctctttaacaaactggtccatctcatagatctggttgcagtaatattcccatttgttattgacagcctcagactctccaccggtaacggtgatcttggggtcgtcgatcataggctcttcgggataatccccgtgtccctgcacagatatggtgtaaatgtaatccggatcatcggaagattccagggcttccataatatattttgtcaggtttctgtcccgcatccagtcattgggattggtgtcatcctgctctgacatatattcctctgaggtaaaactgtcaaatcccagattggcgaagacattctttctcccgtaaaaattggcctcattgttgtgaatggcatgcgtgctgtatcccaggtttttcagtacatagggcgcactctcgcaggttgtctctttcaaaatactcttgtagggatactcgcccggcccaaaatagcgcagactcatacctgtaatagactcaaactctgtgttggctgttccggcacccacgctggggactttatagtagccggaggaatattccttcatcagtttcctgaacgtagggatagggtcctcggagatattcaggaaattcacaagtgtggggtcaaaaaaagattcaagctgcaggaaaataatgttgggacgtttttcccctgtctcaggcaggccgctctcacttttctctatttttttaattgcagcctccgaataatcccttggacagctgatacccgtattgaaaatggtagtagccaggcaatagggatacccgtaatcttcataggcaaacgcaatatttccaaaatagttggacagcaccctcttttcaagtgccagcttggtggttcccgcaaaagccagcacccctgcaagcacaagagggatattcagcttgtaggtcattttcccctggtatttcggtcccttcaaaaacagaaataccagacctatgacggctgccactgccagaacgatcacgatcacaaaaaagaccggtgataaatatttgttggcgatcttaaacgcatctgtgagcagatgcagatccggaccggtaaacggtgtgacacggtttgccagaagcacgccgttgacgattcccagaaccagccagaagatggccagaagggttctcatgaaaaccctccggcgcaccagataaactaacagtgtggtagtgaagatcagaaaggagttgtacagaaacaccaggggcctttccgtcatgtagacatatgcctcaccgacggaatgcctggagatcgcttctatcacaaaatatcccagcatgaccactaccatctgaatcggcagagagagcagattcagatattttaaccacttcttattcataaatttaactctcctatagcctgcgcagttacctgccaagctgtgcaagtctttcctttacctgttccatcatatttgtgtatttctcaagcttggccttctcttcagccaccttgctctcaggcgctttgctcaggaacctttcgtttttaagcattccgtttacacgggcaagctctttgttcaaacgctccgcttctttattcaggcgctcaatctctttctcaatatccaccagctctgcaaaaggcatatagatgacagcctttgatgtcactgcggagacagcgtcctccgcaatccctgctttgtcagactggatggttacttcactggcatatcccagagttgcgaagaagactcttccgttctcaaatacctgacggatctcttcctcctctgaaaccacgaatacttttgcctttttgcttgggggtacattcatatctgtacgcacatttcggatgctccttacagcttctttgatgatctccactgcgcgctcatcctctttgaaactccactcctgtttttccaccggccaggacgcgatcatgatagattcctcctccggatgcagcgtacagaagatttcctctgtgataaacggcatatagggatgaagaagcttcagcgcattgcctagaactgttttcagagtccagagtactgctgccttggtgttgtcctcgtcattgtacagccttggttttaccatctcgatataccagtcacagaactcctcccagataaagtcataaactttctggactgcaatgcccagctcgtatttatccaggttctccgtaacctctgttgccagggtatttactttggagaggatccacttgtctgcgctggtcagtgtgtttagatcgatctcggccggaacctccgctttttccaggttcatcatgataaagcgggaagcgttccatactttgttggcaaagtttcggcttgcctccactctctcccagtaaaaacgcatgtcattgcccggtgcgtttcctgtcataagggtgagccgcagcgcgtcagcgccgtatttgtcgatcacctccagaggatcaatgccgtttccaagggatttactcatcttgcgtccctgggaatcacgaatcaggccgtggatcagcacatggtggaaaggtgtcttacctgtctgctccagtcctgagaataccatacggatgacccagaagaaaataatgtcatagcctgttaccagtacatctgtgggatagaaatactccatctcctctgttttgtttggccatcccagtgtggagaaaggccagagtgcggaggaaaaccaggtatccagggtatcctcgtcctgtgtcagatgttcacagccgcattttgggcagaccttcggcatctctccggcaactgttacctccccgcatttgtcgcagtaatatgcaggaatcctgtgtccccaccagagctgcctggagatacaccagtcacgaatattctcaagccagtgcatgtagatcttatcaaaacggtcgggaacgaactgcagactgccgtcctccagagtcttgatggcagcctctcccatctccttcatcctgacaaaccactggggcttgatcataggctccactgtggcatggcagcggtcatgggtgccgacactgtgggcatggggtactactttcaccagaagcccctgttcctccaggtcttttaccatggcttttctggcctcatagcggtccatacccgcgtatttgccgcccagctcattgatggtggcatcatcgttcatgatggtgatctccggcagactgtggcgtcttcccacttcaaaatcatttggatcatgggccggtgtgatcttcacacatccggtaccgaattctttatccacatattcgtctgccacaaccgggatctctctgtctgtcagaggcagcttcagcattttaccaaccaggtctttgtatctgtcatcctcaggattaactgcaacagccgtatctcccagaagggtctctggacgcgtggttgcgatctctacatagcgtccttcctctccaacgatagggtaattgatgtgccagaaaaatccgtcctgatcctcatgctctacctccgcgtcagagatggatgtctgacataccggacaccagttgataatgcgggatcctttatagatgtaacctttttcgtataatttaatgaaaacttcctgtactgcctgggaacatccctcatccatggtaaaacgttctctgtcccagtcagcagatgcgcccagtttctttagctggttgatgatctttccgccgtattcctctttccattcccaggcgtgcttcagaaattcttctcttccgatctcgtttttatcaattccctgtgctttcagtttttcaataacttttacttccgttgcaatggccgcatggtctgtgcccggctgccacaatgcttcgtatccctgcattctcttaaaacggatcaggatatcctgcatggtctcatccagcgcgtgtcccatatggagctggcctgttacattgggcgggggcattactatggtaaatggtttcttgtctctgtttacttctgcgtggaaatatttgttatccagccatttctgataaattctgtcctccagaccctttgggtcataagtcttggcaagttccttgctcataatctcctccttaaattaaaaaacgccctttacagactgcactgtaaagggcgaaatattccgcggtaccacctttttttctcactcatgtccgttaacgcagactacgcgtgaaggcctactcctgattcatcctttacaaaccactttcttcagccctccggttcaaaagctaccttccatccattcccctgaaacgatcttacagccggtggatcgttctctctgtcaggctccgggatgtactcctctttctcatcaccttttcatacgtcccatcataatcacattatcttggtttgtcaagtgaataaattgtgaaaaataaaaaaataagcccgcttctacggacttatcgctcactttgcaagggatattttccctctgatcctatcctggttctgtaactgtttcgtacaacccagtgaacagttacctgattccttctataataaagggtgcggatacaccaggcaaaagaatcagaggaatccctgccgtttaatctgctgcataattctataaattcaggttcggcctttcggcattccataataagaatttccaatggaaattcaggttgtaaactttgcacggaagttttcaccctactgccatcaagcaggtttcctggcttatggttcatcgcttaaccgccttctcacatttatatgcaatggcattgtggcatcgctccccatttacagtgaccgcatcgctcaggatttgcacctgattcccttttcaccagcactgtgcggccagtgcggatgcacttgattattttatggaattatacatatttatgttaccattgtcaaagggttcagtcaacccccatttgatgtactgttactattcaacctttcggcttcatagcaacaaagacatgcacacagactgcaaaaaccgcagtctggcgcgtagctgcctcgggattgccttgcgaatgcaaggcaacacctcgcgggacaatggaaggctgaactgttacgatgtactctctgcttttttgctttcacgttttcttcttgtcataatgccgccgatccggcctgtctctttggcagaaagactcttccaacctgactccaaaacctggtcaagaagacccagctcctctgctatttcatatttcagcatctcatcacggggaatcttattcagatcaatcttctcattatttttcttgctcatgaaaagtcacactcctttataaataattaaagtctctttcaagtatgacctgttcttttctttttaaacaaatatgattaaaaatgttttatgctcagcggtattccagatgttccctgtttctttcctgataaaaacatgttaccatttcctttgtaacaattacataacacttttgtaacaattaaggaggtctttatgaaacacaaaatattaccgggatttcttgcgatggctgtggtaagcgccatggctatcaccccggtccgcgtacaggctgcttctattgaggatgttaagcagaatctgaagagcaaaggtattatcgtagcaggaaatatatccaacctggacgaattgaaacaaaaactggaaagtatgggcattgactgctccattcccggctggctggtatccctctgcccggaacttccgggaaacggacagccggaaatgcccgattctccggacgacaatcagccggaaaacccggatataccggacaacgaacagcccgaaaacccggacacaccggacagtgaacagcctgaaaccccagattctccggataatgaacaaccggaaatgccggatacaccggacggcgaacagcccgaaaccccagattctccggacaacaacaaacccgaaaccccggattctccggacaacaacaagcccgaaaccccagattctccggacaacaacaagcccgaaaatcccagcctcccggacactgacacagagaatgcggactttgtccgtcaggtagtggatcttgtcaaccgggaacgtgccaaagccggtctgtcacctgtgacagccgatacttccatccaggctgccgctcaggtcagagcaagggagattgagaagtccttctcccacacccgtcctgacggaagttccttcagcactgccctgactcagcagggtgtcacttaccgcggttcaggcgaaaacattgcatggggccagaaaaccccggagcaggttatgaacggctggatgaacagcgaaggccacagagccaacatcctaaataaaaacttcaccaaaatcggcgtaggctaccaccaaaacgcctccggcactaactattggacacagttattcacttattaaaacaaacacattcataagcacacatcataccaaagaccgcggcccagtgttccccacttaagccgcggtcttgttgccataaaattttcttaaccgcacatctgtcaaccatcctcttgcatcctttcacctgccgtcatatttctagatgccgcgttcttcataggttttattaataaaatgcaaataagtatcgtcaggatatcggccgcaggctgggaaacatagataccggacacgcccaaaacgcgcggcagcaccagaataaaaggtacataaaacagaccttgacgaatcagagacaaaaacagccccatttttgacgatccaaccgtctgaaatgtgatagtcatcatataacacaatccgaaagacgggtatagcgctacttgtgaaatcagcagccacttgccgaactccaccactgccggattgcggttaaacagcagaatcaatggctgagccaatatgatatagatagccgctaccactacagtgagcagcagcgatccacccagagcgaacttaactgactggtggaacctctcctcatttttcgccccaaaggcatatgaggccactggctgatatccctgcataaatcccatgaccacataacagccaataagtatcagccgctgcaccacaccgtaggccgcaatgatcaggtctgaatccggcaaaggctttgccgcaatattggtcagtgaagttgccagcgcaagacatatttgaatgaccgctgttgggattccgatggaaatcacagcccacaccagtttgccggaacatttaaaatacctgggcctgactttgatgatagatctgccgctcaaataaaaccacagaaggattccataagtgataaattgggaaactgttgtggcgagggatgccccctccactcccatatccagcccccacgagaacataaatatgggatcaagggccacgttcaatgcagcaccggcgataacagcaatagaagatatttttacagaggattccgcccgtgccgcacagttaaggctttgagcaggcaggttgaacagtgcggcaataaacatccaaaatgcgtaatcctcagcttgcggcaaaactgcatcggaagcaccaaatgcccgcagcaattgcttcatgaaaaggattccaaaaacacagaggctaattccgatcaacatggagattcccacaatagtcgtcacggtacggctggctccctccttatcctctgcccccaactgccggccggcaagcacagatgctcccgccgcaaatatattttctaccgaaaccataatgagcagcaacggcagagtcacgcccaccgctgcaagggcaatatcgctgtccagcatcccaatatatgccgtatctacgatgttataaactgcttttgccaaaagagccagcgtggccggtactgcgagtttaataatcgctttcgatggcatcatcgaggacagcagagattccttgaccatattcttatctgttttcatcttgatcacctaacacaccgtacagtaaaatacccagttgccggtgacacctttcctcatgtttgcgtagggcctgctccggagaatggattcccacaagtgcatccttaaaccgcagattgaaatagtccatatacattctaaaatcgtccactactgcagaaatggatatgccatttcgcaacacggcactttccaaaagaccggtcaaaacagaaatgttcagttcgtcaaagtgcctgcgtgtttccgcaatcctggaaatcagatgagcgggaggattcagcgcagcatcagtgaaaataccaagaaaaagcgggttttcggcaaagaagtgaagtcttgcgtcgaaatatccacgcagccgctgttccacagaaccgcttataccgctcagcgcctgtgtcagataggctgtcagcgcattaaagcattccgccacacaaatgacatagagttcctccttgtccgcaaaataatgataaatgattcccttagaaataccattttctgcacaaaccgtattcagagatgcggctgcataccccttttctgaaaattctcgcagtgcagcttctaatatccgctgccttgacagcgcatttttctcctcacgtttcattcaatcgcctcctcaaaaaaattgaccatgtagtctgtaatttgcattatagcaaaaacagaccacatagtcaacatttcacagaaacttaactccccataaacaaacacatttaatggaatcatcattacggcaataatacacgattattgcctctcactactctccctatttcggtataataattgaggcaataatactcgattattgcctctcattactccccctatttcggtatgatgattgaggcaataatatacgccacaatccccgtccataccatcccaaagcaggaaagtatcacccacgcaagcctcaccagtgtcgggtcgatattgaagtattccgcaatccctccgcacacaccagccagcatataatttgtagatgacctatataatctcttatcagacataatgattctcctttcatctgaaccaatttttacaatttccaattcctgttaccaattctctaatatcaatctcttttatacctgttaaatgccctcgcaactacaagcaaaagcctttgcagaatcctcttaaacgataggaattttacttatctgcggaattctttcctacagtcagcgcaatgaatgcgcagtcctattgaataattaatccccattttcaaataatatatccacagtgcccattccgcattctatctccatatatttttgagcattgctgtcacctgtctcaagagaactgataccactgtgggattcacttccaatagtaactgagcctaacccgcagtctaaatctgtacgatagtccttgcgtttccccgccagctttgccgtcatggttcccattccgcagtccacagagcctgtgttaaaatctataaatgcaatatccattgtacccatacctgtacccagttctgcatcgtctgccctgataattccgctggtgtctaccgtgccggctcccacgtacatgatcaggctttctgcctgcagatcctggacctccagcatccctgctccaatttggaattccgcgtcctcaaaccttttattttccggaatttctatctgaatgggatatttttcaatggagcgtctgcggtaggacctttctattgagagctgaccgtcgtcttggtcaaattccaccttatccttattagaataaactcttacacggatcttatcttttgccgaagagcggatgactgacacatatgcatactttgtatccacatccaaatctattacctggtctgcatcaaactcatactctttaaccgcttttccattcattgtctctttgatgtcatctatagattccgtaaaattaaaatcattgtcactgcgtatccaattcctaaaaggcacccaattaagaccattttccgcggctgttgtcaccccatcccaggtagctcccatgacgagtcctgataaaaacagcgcaccgcctacaataaccagtaccagtgctgcgatcatacaaaattttgtgaattttttcatgaatggtcacctcccctttttcctctgtggatgatcctctggatcaaatcgatcacccagcggaacactgccggcaatacctttgccacgaccagtacaaataccatgaccagcagaatacccacagctgacattatcattcccacaccggaaaatgccagtgctgccgccggattacccagcatgtggatcatagcgtaaactaccatggcaataccgcctcccagaagtcccacgccgcatccaaatatggccgcgatgataccggctgcacctgccaccaaaccaataggtaatcccagaatgccaatgccgattccgcctactaccggaatggcaaggattatgaatatgataatgattccccacataagcccgcttctgtttgtgcgggatttttctgagcggtatccgcttctgctgtaagggccgtcatatcccctgccgccatttccatactggctgtcagtgccgtccttcctgaagctcccctgtccggaactttcctgtccgctgccattctgacttccgtagcttctcgggccaccgtattggctgtccttctgtgtctgcccttctttgtctgtatcgtctttcttactctctgcacctgcacgctccggcatattcctgtcatcaaaaatcccgtcgctgtatcccgtctctgtatactctccgtactccttacggctttcacccaggtctgccttgatgatagcggccaccttgcctgggcttcccagttcctgtatgacagaggattcgttctcctcccctgcatcatcaaaataactattgtagaactccagtgcctcctctctctcctgcaccggaatatcccaaagcagccgttccagctgcgctaaaaattcctttcgattcattttggtatccctccctcaaacaatctggaaatctttgtagaatagttcttccactctgtcttataaagattcagctgtgccatccctctctcagtcagcttatagtatcttcggttcctgcccccgtactcctgatcgtaggtctccaggcattcatccttctgaagtcttctgagtaccggatacagtgtggattcggatacctccaaaacctgccggacgtcctgggtgatcttatacccgtatgtgccctctgtctccttggagacaaccgccagtacaattgcatccaacagtgcggcgcctgtattaaaaaccatatgctcacttccttttctccgaataaaccgtctgcacttccgacggctgcctcccggcacaaaatatgaaaccccgggatacttaggatttgtataatattatattttttacaatactattttatatttaatactatacgccatataatatacttctgtcaatagtattatacaaaaaacatgtttttcttttcaaacgtcaaaaaaagacgtataatgtagaaaataggcagatacccggcgcattccgttgactggatggctatgaaaacagtacaaatgggagctgctgaatattataaaatacggaggtaagaatgaagaataaaatagcaagggtgatcggcgtggtctgcgtcctgatcctggtggttttcggcatatttctgggaagatactgggaggggcgcaaatatcagaaagcagatatctctgtttccgccatcactgcccgtctgacccaagccagtgatctagccaccgcacgtctggaatacaggggtttgattcgctatgaggccggtgagatccgctttatcacccagaaaggctttaccatgatttacgatgcgcacatcaaggcaggcattgacctttccaaagcgcaggtggatgtatccggcgaaaccatcactgtcacacttcccaaagcggtaatccaggatgtggttattgaccctgacagtctggagttctacgatgaaaaaatagcgctgttcaatcctcagaacaaggaggacacggtaaccgcactgcaggcagctaaggaggacgcggaaaaaaatgccgctgacagcgacctgctgacaacggcagacgaacaggcccggcgcctgatccaggaactgcttacccctgtgacccaggacagtgacaaagaatacaatattgtgttcagccagcagactgagagctgacacaaatcgaagtagagaacagtacacactatcaacatcacgtaatatataacagcacataatatatgacagcacataatatatgacagcacataaaaatggggctgctgcacgaaacatgatatgctccctcccaggcgacaagttttattttttcacttgtctgcccggaagggagcatatcacgatcgcgcagcagccctgcttttttattctgcagccacaggcgtatcctgtcctgtcaaaaactggctgttatataatgcggcataaaatccatttttctcaagcagtgacttatggtctccctgctccacaatatttccgttattcattacaaggatcacatccgcctctctgatcgtagacagacggtgagccacgataaagctggttctaccctgcatcatactggcaaaagcctcctggatgtgcatctccgttctagtgtcaatggaggacgtggcctcatccaggatcagcataggcggaaggcagagcatgaccctggtaatacacagaagctgtttctgtccctgggacagcccgccgccatcctctgtgatcacggtatcatatccctttggcagacgtttgataaagctgtgtgcatgggatgctctggcggctgctttgatctcttcctccgaggcatccggttttcccataatgatattgtcccggatggtccctgtcctgagccaggtatcctgtagcaccatcccataggaaccccgcaggcttttccttgtgatactgcggatatcacggccgctgacgcgtatactgccgctgtccacatcataaaaacgcatgagcaggtttataacagtggttttcccgcatcccgtcggtcccacgatggccaccctctgacccggctgtacatgcaggttgaaatcctgtaccagttttgtctcaggcgaataggaaaaatatacatgctccagatccactttcccatctgtatgtttcagatcctccacattctccggctccggtatctgcggctcttcctctatgagtgcgaagatacgggaggcacaggccagcgcattctgcagctctgtcacaacccctgatatctcgttgaaaggctttgtatactggttggcatagctgagaaaacaggagagctgtccaacggttattccgccgtttataacagacaaagctcccaccaggcccacaccggcatatacaagactgttgacaaaacgggtgcaggggttggtcagagaggagaagaaaatggcttttaaagagcagtccgccagcctttgattgatcttgtcaaaatgctccagggcttcttcctcataattaaatgcctgcaccactttctgaccgccgatcatttcctccacaagcgcagtctgatccccgcgtgcctctgactgttgtttgaacatgataaatgtcctcttggcaataaagtttgccacaaagagggaaaggggggtgatcagcaccaccaccagcgtaatacccacatctctggtgagcataaagagcagtgtcccaagtatagtgatgacccctgtgaacaactgggtaaatcccatcaaaagcccgtctgagaactggtccacatccgcgatcacacggcttaccacctcaccgtaggaatggtcatccatgtatttcagcggaaggatctgtatcttttgaaatgcctggtttctcacatcctgtactgtgtggtaggccattttattgttgctcacgttcatgatccactgggccagggctgtaaacaagatcacgatccctatcttctccagagtcaaaagcacatgggcaaaatcaacctttcccttgtcaataatatagtcaatggcttcgcctgtcaggattggcacatacagggtaagagcaaccgtcaccgctgccgctgcaatggacaggatcagaaacggccagtaatggcggacatatttaagtaccttcagaagagtttccttctgcgctgattttttcttgtccatatttatgcctcctcctgtctgctctcaaactgtgattcgtagatttccctgtatacactgcaggtctccataagttccctgtgggttcccatgccggccagacggccatcctccatgaccagtatccggtccgcatacatgaccgaggacgctctctgggatacgataaacacggtcattttatccttcagatttcctatggcccggcgcagcctggcatctgtggcaaagtcaagggcagacgcgctgtcgtccaggatcaggatttccggatttttgaccaatgcccttgcaatggtgagacgctgtttctgtccccctgaaagattttttcctccctgcaccacttctgtgtccaggccatcctccttcttatccacaaactcctttgcctgggatatctccagggcacgccacagctcctcgtccgaggctccccggtttccccagagcaggttttcccggatggtacctttaaaaagtgttgccttctgcagaaccatacctactttttgtctcagttcatggacggggtactttctcacatccactccattcactcttacttcccctgctgtgacgtcatagaatctggggatcagatggacaagggatgattttcctgagccggtaccgcctataatgcctatagtctggcctttttcggccttaaagtcaatatcagtcagggattcctctcccgcgttcttatatgcaagccccacatggcagaattctacggatggactgttctcctctgctttttccggtgtttttttacctgcgtcctgcatactggactgtatttccagaacactctccacacggtttgcacaggccagtgattttgtgatcgttatgatcagatttgccagcttgatcagctccaccaggatctgagacatataatttaccagggcaatcagctgtccctgggtgatatatcccgtgttgacacgtatggcgcctgtccaaagcagcaccaccaatgcaccgttgataattacataggtcatgggattcataagccccgaaattttccccacatgcttctgcatggcagtgagcgtatcgttgctctcttgaaaacgctctttctcttcctcttccttattaaacgcgcggatcaccctcacgcctgtgagattctccctggtaattcccagtacacggtcaagggctgcctgtgtcttcttatacaggggaatagtgatcaacatgatcccaaaaaccaccacagagagcaggggaatggtcaccacaaaaataagggcggctttcacgtctatggtaaatgccatgatcatagccccgaacacaatacagggggagcgcagaaacaggcgcagtaccatattgactccgttctgcacctggttgatatcacttgtcattctggttatgagggtagaggttcccatggtatccatttccgtgaaggaaagtccctggatgtgggaaaacaatacatgcctcagctttgtggaaaatcctaccgcggcctttgcagcaaaatactgtgccgtagcggagcagacaagcccgatgacgcccaggcttaccatgagcagacacatgacagtcacatagtgcctgtctccgtttccgatgccccggtcaatgatcctggccatgacaagaggcaccagcagttcaaaggacgcttccaggagcttgaacagcggtgccaggacagactcttttttatagtctttcatatagatcagcagttttctcatgatgttctcctaccggtaattattttctttcttatttatcttatcacctctttcccggaatgacaaacctttcctccaataaaatgcgctccttctatctgatatattcaggcaccggcacatctttgagtatcctgacagtgacttttgtcccccatccttccctgctgtaaatagacacaccgcattcctccccataagtgctttttaccattgcttttacaaggcgcacgccgaatccgcccttatcccctgcatcgtcccgcagcaggtcccggcaggtttcctgggtcattccttttccgttgtcccggacgtcaaagatcaggtgatccccctcccggcgaagactcacccaaatctctcctccctgttcatctataccgtacttaatggcattttccaccaaaggctggatcagcagtttgggcatcacacactctgacagttcctccggaatatcaatctcatactgtagtttttcatttaagagcagtctctggaatgacaaataggacgacaaataccgcatgtcctcctgtactgtaacaaattcctttttatggttgacacaataccgcagaatatcggccagcgttgccaccacatcagcaatctcatattcatttttcaggaccatcttccaataaatcatgtcaaaggcattgtagaggaaatggggattcagctttgatttaagcgccagcatctccagcttatagtaattgttgcgctgtctctgtactgtatggagcagttccttaatacgaaccagcatataattaaaattgtcaatgatcataccgaattcatcctgcttcttccgctccatagtaaaatccagctctccgttctgtatccgctccatgccgtacagaagctgtttgaccggtctgagaaaggatttgaatatggtgagagctatgatccccacaagaaggacaatacacaaaaagacaataaagagaatagggatgatcttgttcagctcctgtgtaacggctgtactttcaagaatgccgcacagattccagccgaagctccccaaaggatagaccacatgatgttcctcctcctccccctgtgtctttaaatatcttccgattaggtccctgtcctctgtaaacagaatacgcccatccgcatctgtcagcagcattttttcctgacggcttttattcttggccctaaaaagagtctcaaaactatcctgtgtaaactgaacagccaaaagcccgtagactatatccccatcgtgaatatagcttacggcctccatcatacgcggttccccctccggatatctccagagtatatttccatttggcagctcccggtattcctccagaaatgttttatatggctccgctgtgtcgaaaaccgcattcctgtaaaaacagttgatgggttcataatcctttgtatagacgtatacattttcagccatactcagatttctctcccgcagagcttcccgcacgatacgcacctctgtcatagaaaaattatccgtaccggacagaagcccggacagataattcttgacccactgattctccgaaattcccagtatcagatcttccatctgcccagtctcctggctgcatctctcagagacctgataaactgtattttcaaaaagcagatttgtcttttccgtcatgatcttcactgtgcggtaatacagtatgctgaaaagtatgcagataaatatgccgcctgtcaggaaaatcaaaatagtctttatccataatgttcttggtctgttcagcttcagtttattcataatctttcggcacctctgtcctgattttctcgtctgtatcataatgctcaaaataatttctgatttcatccatgccgatcagacaccggtcatttaccgcaattgtgggtacccagagagattcctgctctctcccatgaaggatatagaactttttcagcatttcccagcttcccggttcttcactgcccacagggtaaaaatcaaatttttcatacagctttccgcccagttccccgttccttgtatccagccattcttttgcctcctgacagtcagggcacccctccatggtaaaaaatacgatccgggaaatttcacggctccccatatgtgtttccttattgatccccagcagatatcccagctttttctgccagcttccttcctctcgtatggcggataaaagctttgcctccacctcgtcctgacccagcagcatggtgctgcctgcaaagactgcagggtaggtcatctctgccggttcgctggcagcttccattgcctttgtcagattatttctgtaaaaagagtaaaggacattataaatcttcagatccacctgatccctcactcctgcctcctccagcatgttttccatcctgatcctgtactgccgttccccggtacacgcattgcagggatgatctgtcacagaacatcctccgcactggtcatatatgtagcatgatacaggaaccggtatcctgtttatctcccatacagcataagcccctcctgcaagcagcagcaaaagaacagctcccaacatcattttccctctcaataccggttcctcctgtcttatatgatttccatatcgtctctgctgcccagcacggaaccactgggtgcgggtctgtcctgataccagtaggccacagatgagatgtcatcctgcagcggcagatatctgccccccgaacgccatcccaacgcctggatggtcacttttaaatcctcatcaaaatacaccgggtctgtgatatgccagcggtacatgctgaatctctgctgagttttgtaggcgccgtccgtattggtgatcttagacagacctgcatatggggtacagtacggccggtaaaccccgtccacctcaaagtcataggctccgcagaaataatcctccgttcctgttccgcagatggtgggatactcccggtcgccgtccatgaagaacttgatctcgccttctccccaccatccgttgttgtttactccccagaacatgtaagtgcccacatactgtccttttcccttcactccatccagaacagtatagtcctctttatatggaaggggatttgtccggcggtactgtgcatggaaatatccatggccttcctccaattctctgagctgatagtcaatctggtaatacacgatcacaggttcctctgccaggttctcaagtgtcatgcggcagccctcataaaacggcatgtcccaataacagttcagccccctgcgaggattcacacacactgcgagagaagtaagctgctcatactgctgctcatccgcgcttgcaaaaaaatctcccaggggagtctcaacggaaggaagctcccggttgtcccagtacattctcagcaccagagtcctgttttgcatactgctggtagtcacccagatgtgcttcaccataccctgtcctttgatatcagccagagtaaatgtctgtcccggctcgatctgcacagagggcgaaactttccatcccctgcccagatcccttgcgcaggaggccccggttccctctgtggcctgccctccggctcccttctctcctgtaaagttctcaggacttacagaacgtgtcctgatatcctgcattttacttaaactgctcatatctcctatcatgttttccttatcctttcacaactgttctgctggttcacagttacatcctttcctaaattatttctgctcatagcggtaacacaaaacggtatgaccttctcccatgggatacatggaggggcttttttgtctgcatcgctccgaagcatatttgcacctggacgcgaacttgcaggcagcggcggcaaattcctttgtctccaggtcaggaagtaccatatcctgatcccacttcctccccacaacagggatggattcctgcagaagttccgtgtagggatgccccggattctctaaaattgactttgcctttccgaattcaatgagatttcctctgtacatagtggcaatataatcactcacataataggctgtagacagatcatgtgtaatataaataaaattcacatgatggtcattcttcagcttcctgaacaagttcacaatattcattctgagggaggcgtcgatcattgccaccggctcatctgccacgatcagcttcggttttgtgatcagtgccctggcaatagatatcctctgcaattcccctccggaaaactgattggggaatttcccctggacatgttctatgttaagtcccacttcggccagagtctcacggatcttctcctctgcctcatcctttgatctcataccacccagactgcaggctgtctcgtacagataactgtccacggttcttcttgcgctgaaagcagtaaacgggttctggaagataggctgcaccattttcctgaattcctttttctttttgtcatatacagacaggttctcaccgcccagggtaatttccccgcttcccgcctccagaagcttcaaaaccatttttgcaagagtgctcttcccgcttcccgactctcccactatggccatgatccatggtttgtctgaattgatatcaaggtttacatgatccacagctacaatattggtaccgaagatcatcccacctattttaaaagattttgtcagatccttaatggataaattataattttccaccgctacctccttctctctgcaagcagatgacagctagcctgatgccgttcccccacggagacggatacaggctgttccctgcggcacctgtccgaagctttaggacagcgggccgcaaatctgcagccttgtggcggatttctcagacttgggggcaggccggggatcccttccttttgtgtatcatcccccagtctcggcagggccttgatgagcatctgcgtatagggatgttttggattcccgaatatctcctgtgtagggccgtcctctatcatctgccctgcatacatgattccaagcctgtctgtgatctgatagtgcacccccatgtcgtgagacacgatgaccatggaattttggagtttcttctgcactcttgacagcatagtcaggattcccctctgcaccaccacatcaagcgcagttgtaggctcatccgccagcaccagatccggtcccaggaaggtggcaagggcgataatgactctctgccgcattcccccgctcaactgatgaggataagcgtccagaacctcatggggcagctccagttctttcaggtatgcggtgatccttttttcctgctctgcctttttctctcttttttcctttggaatcacatcgaaaaactgttctctgacccttttcaccgggttcatgacatgcatggctccctggggcacataggagatttccctccaccactcttttctgatctcccctgttgtcaagactttcctttcttttgaggactctgtgatcagggataccttcccgccgctgatttccaggggaaaatccaccagatcatacatggtctttaaaagcgtggacttgccgcagcctgactcccctgcaatacccatgatttcatttttgcggacttcaaagcttacattgtccactgaattcacatatccgctgaccgtctcgtagcgggcactcacctgttccattttaagcattggtacccctcctttttgcccacatctgctgtgctcccgtcatagccaggaacaaaccgataaaaataagcgctgtggataccaccggcgcaccgatccaaatccaccgtcctgccagcatggcctgatgttcatttgcccagtagatcatggtacccagggttgctgtggtgttgctggacatgccgatcactgccagactggattccgcggcgatggcaaccaggatcgtattgataaagttcgccagcgaccagttcatgacaaacggaaaaatctctttccatatgatctttccggtactctccccggaaaacatggctgtgctgatgaaatcccgctccttcagggtcagcgccatggacctcacctgtctggcaggccagggccagttaaagatcaccagaaccaccgccacataaaaaagcggggccgtccccttgagcatactcgatatgagtatcaatatgggaagggatgggattacaataaaggaatctgtcagaagcgtgatgatcctgtctgcccagccccccataaatcctgcaagcagccccatgaaaacacctatggctgtggcaaagaatgccacccccatacctaccagaaaggagttcctgacggagtaggccaaaagccagaaaacgtcctgtccaagtcctgtggttcccagccagtgctctgctgtgggattcatatttctggaataagactgccattccacaggactgactttacagaaaacaggcatgatgaacccgataatgagaaagacgcagagcagtacagttcccagcttcaggcggaaattccagtatttatttgttttgttcttctttcctgccattctctttccccctaactataacggattcgcggatccaggaatggatacagcaggtctatgacaaaggttgtcagagcaacactgataactgaaatggtgatggtacccatgatcaggttgtaatcactctgcaggatcccctgatagatcagactgcccagtcccggaaatccaaacaggatctctgtcaccagagcaccgttgaagataccgcctatctgcagagccagacttgtaacctgggggagcatgacatttggcatcacataccgcctcatgatgcgtccctcgcgcaaacctttcagccttgcgaatttaacatattcctcttcattggcattactcaccatggttttcatgctgatgacccaccatccaaaccctaccagtatcagagacatggcgggcaggaagcagttccagagtatgctcttgatatgtacccagttaaatccctctccctgcaccacaaaagacagcgggaacacgggaagcagataacagaaaaacatgatcagcagcagcgcgaaaatgtaatatggaatgggatacatcaagatggcgatcccctccaaaagctttgacaggggcttgtccttgcggaatcctgccaaaagaccgatcaggttaccgatcagccatgacaaaaccgttgtggtcagcataagtcccagagtccaaggcagtgccctggcgatcatctgcataaccggcgtgggatatgcggacagggatggaccaaagtcatgtgaaatgactacacgtttaaaaaaatccaggtattgatgcaggacagaaccgtccaggccgaagagggaattcatagattccctcatctgcacaactgcctccgggctcatggaaccggcattggacgtcatctgtccaatcatcgcctccaccgggtcattgggcatgagcctggggacaaagaagacggttgtcacaccaataaaaattacgagaagaaacgtcgcaatcctggagagaagaaatttcccgaatttcattgacagcctccttacaattggtgttattcttgtgacaaattattttgcagcttcgatcttagtggtatagaacctgaactgtgaccaccaccaccagggaccctcaaacgggttctctgaatcctggaaattggtccagtatgtctccacaacgggaacgaattttgcagtgccgaacatggggatggcaggcatctcatctacaaaaatcttgagcatttcttccacggttgtcttgacttccgggtcatctgcctcaagtgtctgcagtttatcaatggcagcactcagctcttcattggcgtaacgttctttgttgccggctgcattttccccgttgggaagaatatatttttggtgccaggtctggatattctctgtcaggtcagggatcagtccgcagaaaggccagtacgcacctgcatcataatttcctgtggcgtaagatgtccagaaggtagaggaatcctgctgttttacctcagccttcaccccgaatttgctccaggcatccgcaaccgcaaaagccagacgcatggattctatctcaaagtccgcaggtgccagaatgataatttcaaagggctgtccttccggtgtgatccactggccgtctttttgagtaaatccgtttttctgaagcagctctgcagccttgtctgtatcatatttccaccagccgatcccaaagatgtcggtgatctcctcctctgtggttgggagattttccacaccttctgtcttaaggagttctaccatttccctggccgcgttctcattaaacggtttatatccgtcctcaaaggcataggttttcagccagtccaccattggtttctggtacacatccgaaagcgctgttgtgggaggcactgccagaggggagaacttcagttttccgccgaaggtcgccatgctcacctgtttgatatccatactcagggtcaaggcccaccgcacttctctgttattgtaatattcattagagcagttaaaggaaataccacgctcgcaggggtcgtccggtatggcataggggaattcctctgtccagcatttagcatttggattcttttcctttagaatatcccagctctccggagagatgtcctgcagaatgtcaatttcattattaactgccgccatgacacgtttctcttcacttccgaaatatttgaacaacacgtactggggtttgggttccccgtcgatcacacctacatccgatttgtcccagtcctctctcttttcgtacaggaaccagtttccctgggcatcgcgttttgacagggtgtacggcccaagggaaagaggatctgtgtatttaaaagtggccgggtcctctttttcccagatgtgtttcggaactactttgaaattgttgccaaatacgataacccccagtttctgctgtggttttacatttggttccacaagttccatctcaactgtgtatttgtcaacagccttcatgcttttaacaaaggatttataccagcttccccaactgaattcctctgtagtgctgagtatgttggatgtatactccacatcctcggcagtaaattccacaccatccgaccaggtgattccctcccgcagatggaaccggtactttgtgttcgtgtcgtccatggcctcaggaaaatccgccgccaggtcacaggtctgggccccgttcatggtatccgcttcccacaggcagggataaagaagctgatggagtccgcagtccattgccacacagcctgtcatataggggttgaagttatccggatctgtctgtgtaccgctcagcatgtccacgatcagcgtatcctttctgggtgtccccacatctgtcatcttctcccccgaagcggacggctgctctgatgttccctctttttctccacctgtgccgcctccgcagcctgataacagcagagccgcagccgtggctgccgccaaaatttgtttcccttttcttcgcatctcttttcctcctttgatgattgatttgatgttttccagtatatctttttctgtaaaaaaaactgttgatttcattagatttcttgtaaatatattttatattaaacagaaaaaagcaggaaccatcagtattttgacggttcctgcccctcacacaactcatttatttattcaatattttcattctgtactctttcggcgacattttcttgaatttcttgaacacactgccaaagtaggccgaatctttaaatcccaccagctctgcgatctctcctatctttaaatccctttcctccatcagattgactgccgcttttattctgacctgattcagatattcccccatggaaattcccatatattttttaaactgggaactgaaataccaaggattcagcgatacatactcggctaccttctgcagagacaattcctgcatatagtttgcctccatataagcagatgccagacggatataggagggcaccttggctttctcctggaaaaagctgaggatctgctgcagatatgcctccagatcagtccaggcctgtgtcagagtgctgctgcttctcaggtctgaaagcacctgctcctgttcagacagacgctccagcatttttccggcctcctcggtcttaatgcgctcctccagcatatagcagaaatgcatcatctcccttttcatctgccccggctcaaaaccctctgtcctgttccaaagccgccgtcggccttcccttaatatgagctgaagctgatcctccctcccccgcatcaggatcatctcaatcttggagaagggcagaaaatcctccatattgatctcctccgcccgtcctgttttcctctgccattgttcctcatcccaggtatactgccgtccgttaaagtccatgtaggcttcccgctcaaggagggtatgtgcagtctcctgcagagtctgctgcccccacaaaaaacgctttttcaaataaacagcaccgtcccccgcctccacacagcttccggaaatttcctcttcctctgtttctgataaagggaacacgatccacagtctgtgttcatccacagcggccactgcatttctctttctcagcccgatcctggcccggcaaagaactgcttcccactcctctctgcctctgtccctgtcagaccacatggcacagagacactctgtcttgtccggaaatatacaggcatccatatcctgccggttctctgcacccttcagcagcttcaggaacagacgctctctccgcttctcctccgtctcctgtgcccgctcttttttctgttcctccaccttcttgaatatccccagtatctctttctgcctgcagggtttcagcagatagtccaccgccccatttttcatggcctgccggatatattcataatccgtatatgcactcatggcgatcatgacggtctcaggacatatatcccgtattttctctatcagtgtgatgcctgatatatgaggcattttaatatccgtcaccaccacatccgcctgtcccggattttcctcaataaaacggatggcaggctccgggtctgtaaaacttcccgttatctcataatccggaaattcttccgccagcaaatggcgcattccctgcagcactacttgttcatcatcaatcaacacaaccttcagcatagttatccacccgcaatcctgattcattatctattgtccacacgatccccatcagccttcttggcacttttttgccatatgccgcagatagtaatttctgccggcctcaccgctctgccctctctgcttttccgggcactttatgtacactgttaaacggtgaaaacggcgagactgaggggactgaataattacgcttattataatataatgtggaatcatagacaatggaaactttattcctctatttagctgtaaaagtaaaaagtgcctgcggcagttatccgcaggcagctcttcctctctatgtacccagcacagcaaatttattttttctttatttccttctggaaaccaaagcattcctccgcggccacattactcagcaccagcaggcagatcaggtttgggatcgccataagtccgttcatggtatctgagaaatcccacacgatctgaagggttcttgtggcgcctataaatgtcacaaaggaaaacagcaccctgtagatcctgttcatctttgtggagtgcaccaagaattccaaagatttttccccatagtattcccaacctaaaatcgtagaaaacgcgaacagcatgataccgatggataccagataactgcccattggccccaatgcgctctcaaaagctttgatggtcagatttacacctgttatgacctcccctgaagcatccttcattcccagcacacccgaagacgcaatgacaagaccggtcacggaacagaccaccagtgtatcgaaaaaggttcccgtcatattgatatatccctgtcttgacgggtaatccgtcttggctgccgctgccgcaattggagcggaaccgaggcctgcctcattagagaatacgcctctggcaacaccccagcgcatagcggatgacatttttgccacaatattgccgcccacacctccggctactgcctttatggaaaatgccatgccgaatatctggccaagtccgtcaggaatctgctttgcattgataatgataacaccgattccgcaggcgaaatacagtacagccataaagggaaccactttctcacataccttgccgatgcttttaatgccgcccaccagaaccaccagcgccagagttgtgatcaccacacctgtcacgatattaggaatcctgaatgtgctgctcagtgcatccgcgatagaattggcctgtgtcatattgccgattccaaaggatgccagaaccgcaaagactgcaaaaagtgtcgccagcacagcgcccagtctcttgtgtttgaatccgtttctcatggcatacataggtccacccaccatctcgccgtcagcgttcatctccctgtattttacggccagaacactctccacgtatttggttgaaagcccgaaaagagcggatatccacatccagacaatggctccggggcctcccatgaccatagcagtggcaacacccacaatatttccggtaccaatggtagctgccagagcggtcatcagggactgaaagggtgtgatatcgccttccctgctgcccatgccttccttgtccgggtccttaaaaatagacttcagggcaaatcccagattgcgccacggcaggaatttcagacgaaaggtaagaaaaacacctgtgcccaccaacagtatcagcatataagggccccacacaaaatcattgaccgccttcagtattccagcaaaatccatacgtaacctccctcagatgcgccaacgcagaaaaggacagaccaccaaccgtctgcccctttgctccactgcgtcatcacatcaacgttttattcttttttcatatcataacatgtgaagaggggtttgtaaatctaaaatcaccatcgccacaggcgattctgcatgatttttgctcgtaactgtgagggtactgaacagttaccttttatttattttccagtaaccacttctgctagaaccctcacggataatttttcctgtttcccgcagttctttgataatacggctaatttttcttgtactaaatcctgtttgcttgcttattttctttgccgtaatttggggttcctgctttagcaataaaagaactttatttttatcatcattatcgccattattgtcgccattattatcgccattggcggcaatctctttttgttctgtcgaaataaatgggaagatgacctttataaaatgatcagatatctcaaagatacttttgtcataataatgcaaaattcgactcattccggatcctaattgttctaccaaccccacatccttaaatactctcatcaattccctgtttcttggcatactgctgccgctaaagaagtcttccagactttgtccgggaatcaatcctccatacgaagtaaaaaccatcctatcagtaaaaatctcaaatactggaggaatttctctcgaaaaatcattgtgaacaatagcattgatcaatgcttctctcaatgggattggttcaactaaatttttttctattcgttttgtactggtaaccttcgtccttgtaatattttcaatcttcattttctccagaacatgattggcagcctttagcaacgaacaataaccatattcttcactttctattaaatccaccttatccgtacctgcatattttgccactttaatagatacaccattttcatctgccaacaaataggcaatataattaaacttaccttctggtgttaatagttcgaggctgctcgcaaagcgattatttaattccagaccacgctcctgataatatattttcaattgtgtaaacgtaagatcttgcctaggagccggaacattccgtaaagttgtatgaacacgtttagaatacagttcgtctatcatagctgtcggcattggttgagtagatgttccgagacgcatgtagcatccatttggagacatccctttacttttaatataatatggtttttcaagcccgctggaaacaacaattttagttactggaatgccttctatgctttcagtaataatatcaaataaccccaatgctgatggtgatatgttatttttaattctatccgctattctaagctgcattccatccatgtcagaattctcaacaggatagccctcatcagatatgccaatatataaaatgccaccttcatgattgttaagaaaagctactacttctttctccattttatcatttagttctactttaaattctactttattactttcttgcagcattataacaccctttcttacaatagttctaaaaacgtattatatatagcaataatactcattttgagcgtttcgttttgcaggtgcgatcaaagttattttaataaataatcgtaactgttcagtacccttataccatcaattccttctgtaaatccaccgaataaatatacctctcagacaccttcttccccgtcatccgttccagggcttctgtatagtaatcaagctggattttatacttttcaaccaggtcactgccgtttctttgccgcaccctgtctgtcttgtaatccaccagtacaattttttcctcctcatagaaaaaggcatcaatgatcccctgtaccaggacactttcatctcccgcatactcttctctcagcctgtctgctgaaatactcatgacaaaaggctgttcccggtaaagcatgccctgcgcctgggcttttgccatacgtgttcccaccgaagacacggcaaactgatacacatcacggggtgagactgtccggcggatctcactgtctattctgtgttccgcctccagatctgcaagctgttcctccacctctttcggggacccggcctttgaaagatttaggcattcaaataccctgtggtatgccgtacctcttccggctcctgtcagcccctcctgacgcttctcaataaaggacgggatatagggaaccatctcttccgcctcataccaggacgtgctctcctcatcctccatgtgcagtctcttcacctcggaaacagtcacctttgccggaatattttcccggtcaagataaggataggaataggaaaagcactcctgtatctgctctctggcttccacgtcatagctgacggatgtgtcaaaatccagaatctcctgttttttcatcttttgtatcattctggtctccgcctcttccagcgtaagctgtgtgggcgagatcacctgtacgaaaaatccggcctcattgtcatgaagaggattcagagcatacggacgtttctcataggagaggtacacctcatccatacaccggtgccttgcaagcgcgggaaagatccagtccagataacagcgggcttttacaagcttaccgtaagatatcctgcgctcttcctgcttcttgacaggctctaaggcagtcagccgcttctccagcctggaggtgcagccggtcaggatcagcttttcctttgcgcgggtcagcgccacatagaggattcgcagctcctctcccagattctcgatctgtatctgcctctgtactgcctttttcagcagtgtaggggtcctggtcctaaactttgcatctacccagtcagcacccacacccagatcaggatgcatgaccagagctgccctggcatcctgctggttaaactgttttcccatgccggagacaaacacaaccggaaattccaggcctttgctcttgtggatactcatgattttcacagtatcctcattctcggaaaggatgttggcctctccgaaatccacctgatacttctgcaggttttctatatacctgacaaaattaaacagtcctctgtaactggtgctctcataatctctagccttctgaagcagcatgagcagatttgccttctgctgctctccggatgcgcctgcccggatatagtcaaaaagtcctgtcctatcataaatctcccacaaaagttcatgcataggcgtgtagggaaccttactcctgatgctcctgtacagctccaggaattcatgcgcttttctgcccatctctctgtcatccgtatcttcagaatccctgagactttccgctgccagaagcgcctgatacatccctgtcttctccatttccctgcccacacatttgatacgggccagctcctccatggaaaatcctcccggcagattgcgaagcgcgccggtaaaaggaatgtcctgcagaggattatccagaatacgcaggtagttcagcacagtcatgacctccgacgcggaaaaataccccgtctttgtggtgacactggcaggaatcccctgtgcactcagaacacgcttaaaggtctccgaccagccggacagggtcctgagcaggatcacacagtccccatataccgcagggcggtactgccccgtgatcttatcgagaacgggatatgaacccaccagctcctgaattcttcccgccacggctctggcctccagctcctgaacattctcaccggactccatgactttccactcttcctcatctgtctccaccaggagaagctctgtgtcctggccatccttccggttctttcgaccatccggctgttcctcctgcttgttctcctgatacggtgggaatgacgctccgggatacagagccgccgcatcgtcgtattccacctttcccagagcttcccccatgatctggtagaagaggaaattcactcctgccagcacttccttcctgctgcggaaatttttatgcaggtctatcctcagacagtttccccctgctgtggaataagtcctgaacttttccataaacaagtcaggccttgcaaggcggaaacggtaaatactctgcttcacatctcccaccatgaaaatattgttgctgccgtcatccatcttagacacagcatttaacagcttttcttgtacaaagttgctgtcctggtactcatctatcatgacctcggcaaatcttcccgccagctcctttgccgcctgggtcctctcgtccttctccccggaatggtccaccaggatcttcagggcaaaatgctccagatcggggaaatccagtatattcttctctctcttcttctccgcaaaagcctgtgcaaactgcagcgtcagatcaatgagaacactcaccgggcctccagccatgcgcacatactcagccgctgcgtccagggaaaggtagaaatactgttccttcagctcacccaacaggtccttgatctgctgccgaaggctcttcgccaattcttttgcctcctcagatacctggggatctcttttggctgaaagcctggcaaaagaaaggcccgaaaacagtttctgccactgagaaaaggaatctgtctgtagaagtttctgtacaaaaaccctgtcagattccagtgcgttttcataataatacggcccgccctctcctctggcagtctccagggccgcttctgtcagactgagagcttcctgcagactctttgtgatatcctcttttatcatctgcatccattttgcctgctccagttcctccccggaagagatggcataagcctccttacaggacaaaagccattcctcaggatagggatagctgacggaaaaggcatagagacgctttatcatatcctcaatgccctcgtctgtcttccctgtggaaaagcattctacaaaccggagaaattccggttctttcctgctgtacgcatcgtcaagcacctgagccgccacatctccctgcatgagacgcagttctccctcctctgccatccggtaagacgggtccagatcaatgagatgaaaataattctttaccacataagaacagaaactgtcgatggtggtgatctgcgcgtggtgaagcagtgtgctctgcctctgcagatgttcattgtcctcatcctcagcaagctttctctcaattgccaggcggatacgttcccgcatctctccggccgccgcccgggtaaatgtcacgatcaaaagtctgtcaatatccacaggatgtgccgggtcggtgatcatggaaataatacgctccaccagcaccgccgtcttgccgcttcccgccgctgcgctgaccaatatgttgcagtttctggaatctatcacctttttctgctcggttgtccacatcactcccatttttacacctccttatccaccaaacgctctgatttttccccatctctcatcttgtcccatatctcctccggcttcagggcattcagtctccggtagcggtatcctgccgttttctcgtcaaacccgcaggcccctttgtatggacaatactggcaggcattgcgttttcccatctcgtagggaagcgtctctgcctctccgttcaggatcctgcggccgatctccttcatttttaagtttacataattcgatatcaggcggaactgttccgggctgaccgcactggaattccttgacagacttccgtccttattgatggtcacaggcacacacagggaggccgtgccgtttgcactcagattttcatccagcttttccagcacccccctgtctgaagatgccaggccgttcatgcgcagttcctttaaaatacggcggttcagggcctccgggtcttcctcttctatcttctccaccacggggtctttgatattgtagtagaagatacccgcaggcaccacctgtttgtcaggatggtttctctgctccagttccatagccgcattcatatacagcacaagctggagctgcaggccgtgatacagggccagcaggtcaaaggaagtgtttcccgatttatagtcaataacctttacaaataccttgtcctcctcctcgcaggtatccacacggtcaatccttcccagaagcttcattttctcctcttttgacaacgcgatattgatactctccagggagtccgccatggcgaaggagacttcaaaacggctgggtgtgaaggccccctgctccatctgctttgtcaaagcccagatcgtgcgcttcatcatcctttttacacggctgaccatgtactcatttctggcactgcttttcagcactgtatttccatagtaagaaaccacttcctccacgcaggcgtctgctatctcatccatctgctcctcatccagggcagtccaggaaagaccgctctggtgcattttcttggcaaagctttccagaccgctgtgcagcacatttcccatatccatggggctgaactcatacctggcccgctctcttaattccagtccgtatgccataaagtgcgcacaggcacactgggcaaagagttccaggcgtgtggcgctgttctccagggtggtgccgtagagggcctgcgccacgctcttcccgatctcatcctcaggattgactctgaaggcgccttccaccatattctgcatggtctgtttccattcctcctgctgctgataccaggaaaacagctccttccacagaggcgaaggctcccggtccagaatttccttgaacccggatgcaagatattccagagcactctggggattttccaccttccataccgcatctctgcagggatactcggggacaagccccggaaacagcttctgcaccgcaccgatcaaaaaggactgggtcatgggttccccctcatcatcagctctgctgtacgacaaaaacagtttgtcagagggttttgtcatattcagatacagatagaatctctgtgtgtacagattctcccgataagtgggagccagtgcaaccaaggaggccttcaggtcttccctgtttagatccgacagtattttccctgcggcgtcctctctgggaatctttccgtcattgacacccacaaagaaaagaaccttgatgtctttcagcctggtcctctccatatcgcccaccagcacctggtcagagcttgggggaatgataccgatcttcacctcagaaagccctgcctccaaaagctctttgaattcccggaggcttaccttctcctcccccagcacctctgtcattttgtcaaaaaggtccatgaccatgggatagatctgggcatactcttttgccctgtccatggcgttttcttccacgaatctcttttggcttctgtcaagcttttcctggataccgcaggcagtgataaattcataaaatgccagaacacgctcccggaccgtaccttttcgtgtcttcatctgttccgtaaacggtaataaaagctccataagcccttcccggatcttttcgatctcaggaacctcctccggcttttccccccggtagtggagcacccattcctcctgccatttgcgaaagccccggattcccataccgagtacatagttctccagtctgtccatatcctgtccgggcatgtccagcagtccacagcgcagcagccggaatacactctcatagctgtagttttccagaagcatatccactgccgagcggagaaattccacaaagggattcatgaacacagactttttctgatcaatgaagcaggggatatcaaacttcccgaaagcccttgccgcgtggtccgcataggtctccatatctcctgtgatgacagcaaagtcccggcacctgtacccctctttccgcatgagacggcggatgataagggcggtctcctccatctcctgggccggattctggctctcccatatatggactgcctgctgctcttttctgtaggtatcctttctgaaccggaacaggttccgttccaaaaattccataggtttattgtgggaaaatcttccttttcctgttacccaggtctcctccacctgacttcccaccgctctggaaagtttacataactttgacaccgtttccctgctcagatggaagagatgatgaggacttccctgccggtaggcatccacccgttcatccatagtcacggtcacatacatggttttacacaggggcagaaccttttccagcagttggagctgaatgggggtaaatcccgtatagccgtccagaaccatcacgctccctgacagcttctttgattgccctgccactcttcccagaacctccagcacttcctcctgggtgatgaaattcccttccagataatcaaaaaacccctggtacagcacagagatatccttcagcttgtagtaaagctccggcttatcctttgcatagtccagcatggtgtccatatcttcttttgtcacctcatactgcttcagttctgacaccatggatttcatctgggaaatgtaaccctgctttttcatcttctctcccaggatcttcagttcctttttcttctcctgggataccttgcgcagcaccaggctctttccggtctcctccagtacctgggcacaggattcccctgtctcctccaatacccggtaggcaaggcgctcaaagctcagaacatcaatgttcaggattccctttctcgggtgcatcatcacaagctctttctgtgtctgcatggtaaactgttccggaaccagcaccagatactgccgtcccggatgttccatggactcctgtatgatcttttggtaaatatagtgggattttccggctcctgaagcgccgaaaataaaatgcagcggcatggacttcctcctttttgtcagttcataaaaaacttctctatcacttcttcaatcccgtcttcatcattgcttcgaactgtgacataatcagccacatccttgaccttttcttgggcattagccatggctgccccaagtcctgcaaactgtatcatggatatatcattatatccgtctccgcagcacaccatctcctccctggatatacccaggatcttcaaaagcttctccagacagtaggccttgtccacatttttgggcgttgcctccaggaagaacggctctgagcggaaaatctgggcttcgtgaagatactcctcagccataagtggctcaatgcgctccagttcatccggctcccctgtgaggagacatttattcaccggaaagtttacataactcggaaagtcttttctataagagatgggcagtccggtgatcctggattctgtctccatatagatatcaacgggagttcccgcaatgatgcggtcctcctcatatgtgatgatccccactttatgccgtactgcgctgcggtagagctttctggccattcccaggggaagggtcttggaatagatacattcctttgtcttccagttcacgatcctggccccgttaaaagccaaaacataacttccgtatttctcaaattccagttcatccgccaccggagcaatgcctttggttggacgcccggaagcaatagccaccaggattccctgttcctgcagttttttaatggccgcttttgtcctgggggtcacttttttttctgtattggtaactgtgccgtcaatgtccagcacaagtaatcggtatctcatccttctactgcctccttagcaacaaaaattgtctgcaaccagtgtatcataaatcggcaatggaaccaaccacgtttttgtcctcctcaaaagaatccttgcatattttccccacttccataataagttataaaaaggaatgcaggaggtgcagccatgagctcaaagaccaagattgtcgtattacatatgaaagaagtcatttataccattattttcgtggtacttgccattcttctggcggttcttctctttatgatgttcggaaaagaccggaaagccgactcagccgccacttcagccgctgtctaccacgctggcgtttataaaagccccataacactaaacggcaacacatttgatgtagaggtcactgtggatgaaaaccacataaatgccatatctctggtaaatctaagcgagaccaccactgccatgtatccgctgatggagccggcactggatgcgctctccagccagatatacgcatcacagaccacggaaaacatcacctacacagacgaaaacaaatacacctcaatgcttctgctggacgcgatcaacgaggcccttgacaaagcaaaagccgactgaaagaccatggccggcataacaggccgaagctttttaaaacggggatgttccggagcatccccgtttttttctgtcattcacgtctgccattcacatctgtcattcaaacctgcatttcccaaaactgcttctcaatttatagtaagagtttcccccgcatagatcagattaggatttgctatcccgttggccgccgcaagctgcgaaaccgtagttccaaacctgagagcgattcctgacagcgtatcgccgtaacgcacaacataagttctccccacattccccgtacttcccgaggaagatatctgcaggacctcgcccggatagatcaggttcggatcagagatatgattcatagccgcaagccgcgcaacagacgtcctgtacatccttgcgattccccaaagggtatcccctctgcgcaccagatatgtgcggtctgcttccgaagacggagcattatccataagcgtgatctttaaaacctctcccgggtagatcaaattgggattaccaattccattctccgaaacaatagccgaaacactggttctgtacttccgggcaatcccccaaagagtgtccccgcttctgacggtatattccaccacagaggcagaaggctccggcataggcaccggccttaccacattcacgggtttctctaaaaacatcgcatccgtaaaatgatccaaatccacatatccggatatccccgccacggtaccagtgtccgaatactgccatccggcccaggcatcccagttcacctgtgaggacggtgtggaaacaccatattccgcgatccagagaggataatccgtaagttctcccccaaacgtagccccggcattataggcgtcgctgtacactactgtgcccttaccgctcaggctctccactgttctgacaaaagccagcccaatctcattggcctgggcactgcttaagctggtcagatcctcaaaatccatagccagacggcactggaactcctttccctgaatcgtattcacaaaaaaatgggcctgatactcagcctgggaaactgtcctggctgtcacataatgataaaatcccacattcagcccggctgctctggctctctcatagttctgcgcaaaatacgggtccgtatagtcgcaccccaggctggacctgatataaaccgtatccaccccggacgcagccaccttattaaaatcaatgtccccctgccacatactcacatcaatcccctgatgtctttccccttcttccggcggcagcgcaaaaaccgatgtacatcccaacaacaataaaacaccaaaaaacaatatatatgaagatactttccgaatcataccaataaaaatccttttttctctatcatatgacccttatcctcatctgccaccctttcttcttgatccgtcccgtttttttataacgttttcatcctcttgagcaccagcttctgcggcgcccaacaagcgtcccaagcaaaaacaggaatatcccgtagggattatgcgcctttcagcacatgattcctacggatattcctattttggggttaaaaataaattccttattcactgacaggctcttatgtcgtaaaaggggcacgcctatcctttcactgcccctgccaggatcgcattctgcacctgtctgcttaataagatatagatcaaaagcaccgggaacgtagccactaccattcccgctcctataggtccccattctgtgtaatacatacctgccagactctggatacctaccgtgagtgtcttatatttttcattactgataaaggtcattgcaaacatcagctcattccaggaagataaaaaagtaaaaatggcaatggtggcaagtgccggccggaccagaggtaagatcaccctgaaaaaagtctgataaatgttacatccgtctatacaggctgcctcttccatctcatacggcacggtagaataatgattgcccagtaccatgatcccaaaaggaagcgcaaacacaatatagggtataatgatcgccagcggcgtattcaaaatattcaacttcttaaatacgataaacagcggaagcagtgttgcgtgaatggggattgtcagccccgccatgaaaaaccagtaagccgctccccgcagtttccacttcattcttgtcactgcataggcaaccatggagatgaggacagtagatataacgataaccacaaccgccaccattatgctgttgcccaggtatctcaaaacctttcccccaagcagcgcgttctcataattttttaccagccagttttcaggaggccccataatgttgccgccaaagatttcctgattactcttgaacgagaaaaacaccagccagatcagcggataaaccgaagtcactgtaaaaaagagtaaaaataacataaggatcaatttcacacactttttgcagatactgctttttaatacttctctcatgttctttctcctccccttaatattcaatgggtgatgtcttcaccagccgctgcagcagatacgctatggcaatacactccactacaataaagattgccgccgcacttccgtacccgtagcggttgatgacaaaaatactgttgaacatcaaagaactgggcacttccgtagaattcaccgggccgccgtttgtcagtacgtaaatcatgtcaaatgcttttaaagaacctgtgataacgaaaatggcacatgtttttaaagtgggaagaattaaaggtatcgtaattttgatggctgcctttatccctgtcgctccatctatctgcgcagattcatggatatcctttggaatggccttgatcgccgtatataacagcagcatatgatatcctatattctgccagatgatagggataaatacgctgaataaagcggtattcacatcacctatccagttttgtgtcagattttccagtcctatcattttcagcagttcattcaaaaccccgtaattagggttataaattttaagccagagctgaccgaccactactgtagacaaggtaaccggtataaaaaaaatggtacgaaagataatctcaccctttacatgggacgccaagatcagcgccaggatcaaagccaatggcagctggatgagcagtgtaaagataccgagaaggaaggaattgatcaccgccctgtgaaaaatagcattttgaaacatttctatgtaattatcaagacccacaaaaatcccttttccgataccatcccagtccaacacactgtaataaagagaaaacagtatagatgcaatcagcaggcccccaaataacagaaaagacggaagcgtaaatatagcgattgcctttttatttcctaaaaatctatccaaaacagcacctccctgcttttaaaacggcagcataatctgtgggatagagattatgctgccgaaattctattatttcctggttgccgtcattgcctctatatattgttccgctgtcgtctgtttcgcatagattccctgcaaagaattactgtggatatctgctgtctccgcatccagcagggtatcccatgccaggcagaacccgtctgcgttttccatcagatccgttaagtttttctgcatatcctgcaatttggcgtctccttcatatttccatgtgggaaggtgcgcaccgctctcgtagccataatcagaaaatttctggctcataaatacggcaaactctacggcttcttccttctgtttggattcagaggataccaataatgtggcactggcgccgcccacgtaagtatcctgtttctcggctccgccctcaactgtaggccagtttgtcactgtcagatgtcctgccagtggagaatcctcatctaaattggcaacgccccagcttccgttatagaacatggctgctctgccttccaggaattcattcttcgcctcgtcattggtgagcgccactgcgctgtctgaaaagacacctgcattgaccattttttctaactcattagccgaatttttcacaaaatcctggtcaaaattgccttctccgttgagcagctttgtattttcatcaacacctccgtagcgaagggcaagtatgccgaatgggaacagccccggccacttatctttttctcccaaggacacaggtgtgataccgttttccacaaataccttagatacctcatacatctcatccatagtttccggtatttttaggccatactggtcaaataattcctgattgcacataagtacgccgataaagctgtctaagggaagtccgtataaggaatcatcataataaaaattattacaaatattgggcatcattttatccatatcaataacaccgctttccacataaggatcaaggttttccacaatccctgcctttacaaaggactgggaaaatccgccgccccaggaataaaatacatccggcgctgaacctgctgccagggttgttttcagctttgtcttataagcctcattatccgttttatcctctttgacagtgacatttggatgtgtctctttgtattcctccaatgctttattccaggccattacctgactgtctgtctcattcaccataatgtgggatacggtgagttctattcctttttcgtccccgttatccgcctctttctttttggtctctgaccctccttcacttccgcaagccgccaaagacattaccattgcagccgccacaaatgctgctaatccatttttgctgtttttcctcattttccttttttgctgagatgccccagcaattcctcctttctgagttctagagcgtgtcttaaaatttattcctgcaatctgcacgccctaacgttttcttataaatgtattatagctatttctgcgctttcttttacttttgctttttactatttctattaatatttttaccattgcacttaaatttctgtttggtgtgtgtcttaaaatcagaaactgcaccgcttcagaaagccggtgcagtttcatttataaggctatgactctttatatggggtctaacgttttttggatcggtattcatagggtgtgcagcctactgcttttttaaataggatccctaaataattggcattgccggtccctactctttccgccacttcatagatttttaagtccgtctcttccaacagggattttgctttttcgatacgcagggaatttacgtattccacaaaagacactcctatttctttcttgaatatccggcttaaataactgctgttcagataaaatttctcagccgttcccgctaatgtcagctcaacatctgacaaatgcatggtaacatattcttttaccgcatagatcagactggagggtctgacagatttttcatcgtgaaacatattcatgatctttctgcacatatccagaaaacattcctgcagaagctttaatgtggggatctgaaagatccgctgataatactccttataatcctcatggaagtcaaaggacgcttcttcctttgtattcatagagtagatataaaagacagcatttaaaagctgcagcttcagataaaacagatccataaaattaatatttttccagttttcaaaccagtgatcaaccagttcctccactttggccggagagtctgtttcgatataggcatacaattttttcaaatcttccatagatatgggattcgcgatcccctcaaaccgggaaattatcatttcctcctgatattgattatttccgaagacaatagcggaattcaaacggttatttgccgtaatataagacttataaatgtcttttagcaatccctctccgtctccaattccataataaatggggaaatgaaaggtttttttccatttcccttctaattcagccataaaggtatcccatgaaaaatcttcctcccggcagagtaatactatatgctcaaacttatccagaacccagtaaatatttttatgttccagctctttttccagataacggctcatccagtccttgttccctttttcaatctccctgccaagcaatatctgggaaaaatcatcaaagcttatcactgcagtctgatagaagccctctttgccgggcagcagagaagccacagccttttcagacaaagagtccttgtgcagatcaggttccagtaattttctcaaataatattcacgtactatgggttcattctgctttctgtagtctgacagctcacgaaacagcttatcctgtgactgctgggaaaaaatgctttcttttacctccagcgccacggtttccagctctttttcgtcaatgggtttgagcagataattgtccagtcccacccgtatcccccgctgcgcatattcaaaatcatcatgtcccgtaaccgcaatgactctcacattgggacagatcccctttaacagcccggcaaaagacaaaccgtctaaaccgggcatgcagatgtctgtcagcaccacatccggtttcagttcctctgccagttgaagggcaccctgcgcggttccaagctctcccacaatggtgtatcctaatttttcccaatcaatacaattacggatatactgtctgatcaaatactcatcatctacaatcataagtttcagcttctgcatataaccaccccttatctctggagatttttcataggaatgtaaatctgtatcttggttccctggttgatcctgcttgttatcttatagaccatatcactgccatagcagtacaccagtctccggatggtccccatcaagccaaaggacttcccggctcctgtatttttgccgttcaggacactgttcagcgtattttctgtcattccgatcccgttgtcttccaccaccaggcttaaatatcccttttcctcttttatccgcactgcgatacagccctcctccacgaaaccgtggatcccatgggtgatggcattttcaactaagggctgcaagaccagctttaagatcttatatccgcccacctccggcgccacatcataatccacctgaagcttttcaccgtaacgcatcttctggatttcaatatagttggccaccatttgcacttctttttctatggtgatatattcatcgcccttgctcagactgatcttataaaactgagccagctcacacatcatgcgataggcatcctcatatcgttttaataaaaacagggatttaatggaatcaaaggtattataaaggaaatgaggattcatctgcgtgctcagaacctccagctctgcctttcttttctgcatttccacctgttttgttttttccagcagattctggatctcacccaccatctcattataaacattgatgagattctgcacctcatggtgctttgtctttatctcgatctgtttaaagtgtccgttctttacctcctccatagattccattaatttttctatggggcgcgtataccagtgggacacgaacagcgcggcaataatgatgatgaccgcctggacagcaaggagtatcatagtcagcagcacatttcctttttcctgctggtgaaaatcgtcaaaaggagtcactcccatatacgtcagagtctccgcctgatacacggatatctgacagcggacgtctcctatctgctccaccgcagagttcctgcctgctttcacaagcgcctgtcccatacgctctgcttctttctgcatactgctgtctaatgtatccagcagcacatggcctttgtcagaaaaaatataaaatttcatctgtgactcattgtcatccagattcagcagcagcttctccaccatctcctgagagatatggatcaccatatatccgatggtctgcatggaatcaaggctccgtatggcccgggcaaaggaaattcccggtattttatccggattacggaaaaaatcatcacagcggtacatgacatgataccgcccgtcctgcccaacgtcctgaaaccagctataatcccttattttactatgctgcaggggattgtttcctgacttgtctgaataacacaaaaatttttccgtgtcaaaaatataaacagactctatcagatcgatcttggagatcagttctatcagggaagcttcaatcttttctatattgcggaaatctgttatctcctccttttcctttaccagcccctgctgtaaatcggaatctgacagacagatatacgaatatgtattgatattttcgataatattttccactaaagtattgacacttgttaagttggtgatggcggcttcctgggtattctcatataaaatacgcttattatacgtctgaaaaattgcaacggtgcaaaggaataccagcgtgatgatagtgatcatcagaatcgacattttagtcgcaattttctttgaataaataaaatgctgtattttattcttccaatcttttatatttggcataattttccttctaacgtcataattttcaaagaattttgtaaattatacaatagtattgtcgaaaaatcaacaacgtctcgtatcacgtcagtacaattggaatacactttcagccgttttccaaaatacctgatccatatccccagattccaggatctgcttatatttttccagctctaccattacattgttcacatggtctgaggcgaacatcatcctgtgcggtcctatctccctgtagatctccctggtgttggaaatccctgtccaactagtctccagataaatattgggacattctttcgccacaaatatagcctggtgggtatcccagtccataccggaatgagcgatcacaatcttcagttccggatatttcctggctgcctttaatatcttcaaaggctgggagaacggaactcccgtgcctgtatgtaccatcatgggcacctgcagttcattggcaacggaaaaggcaaacatgccgtcttccgattccgggtccaccgcatgtcccacaggcgtgatcttcagacccacaaatcccagttccttgacacatctgtatgcctcctgtctgtattcctcctttgtaaaatgagggtagatagaggccagtccccagaacttcattttttcgcaggagcacagacgggcaatacggtcatggatctcctggtttgcctgcagggaaaatctgggcagagacggctggacaatagctcccgtcaccggtgtggcttcgtatccgttcagcagatcttcctccttaatatgatggtcaaaaacacagtcatcgcccagatgggcatgtacatcgattattttcatacaatataaatcctttcttttccggaaaccaattttaatactacagcgaacgccatatgcaatgaaagccgctgctttttccgtcccctttccgcacctgttcgctgtagtaccaaagtatatttaaatacttctctcatcatccgaacctgatctacagttcacgtacgggaataattcctcctttggatgcagaggacacattccgggcgtattggtacagacagcctgttatcttcttctgcacgcacgcatttgtccggcggcgttctatgaagtcaacgccaggagcctctatggtcccctgcagtacatctaccaggatttcatctccgtcctccagatatgcgatagggccgtcatcagcggcttccgggcagatatgccctacaaaacagccgttgttggaaccggaaaatcttccgtctgtgatcaggcacactttgtcacccagatccattcccaccagcagtttcatagccttgtacatttccggcatacccgggccgcccttggggccttcattgcggatcaccaccacgtctcccgctttgacctctccgctcctgattcccctcagagccgcctcttccccctcgtatatttttcctttcccgcggaagaccagagctttctccggaatggcggaaggctttgtgaccgcaccttccggtgccagattccctttcaggatcttgatgccacccattttatgtacagggttttctatggcatggatcacatcccttctgtgattggctgcgttctctatcacttcctgaaccgttatgcctgtgcaggtcttttcctgtgtccataaagcctcctgtaactccttcatgagaacagggatgcctccggcctcataaaaatccagcaaagtattactgccggcagggatcaaaggtaccaggtggggaatcccctcacatattttcccaaattcaaatacagacatctcaatctcaccttcataggcaatggccagtaaatggaggaccgcattggtagatcctcctatggccgcgttcactctgatggcgttataaactgcctgttttgttatgatgtcccttatttttatgtctctgtgtaccatttccacgatctgcttaccgcttttatatcccacagacagtctctcactatacactgcggggatggctgccgttcccggcagcatgattcccatggcttcggccagacatcccatggtgttggccgtccccagcatagcgcaggagccaatggagggcatggcatggtcttctatccatttgaacttttcctcactgatcagtcccttcttcagggcgccttcagactcctggataatggaatggtcaatgtattctccgccgtaaggattcccctctttcatacgccccggcagactgggaccgccgtttaccagtatggtggggagatttacccgcatagctcccatgagcatccccggaatgatcttgtcacagcttcccagtaaaataagcccgtccagcctgtgggcttctgccatggcttctatactgtccgcgatcatctgtcttgtgggaagaatgtactgcattcccttatgtcccatagcgattccgtcacatgccccgatgacaccgaattctaccggtgttccgcctcctgcctgaatcccttctctgacacgctccgataaatttttaaatatcacatgccccgggcagacagtgctgtaggaattcaccacggcgatcattggttttcccagttcctcctccgcgtatccgtccgccttatataaagcccgtacatttgcccactgcggtccctttaaaatatcactgcttcttgtattcataaccgtactcctgctctatatgttaagtatctattttctcagcgtgaaacgatagtttccagattctaaccggacacagtatccgttatctgtctgttccaccaaacggatcccctctttttccacttctccgggcagtaagacatcactgccttcccacagagtctctcctgtgccgggaagcagcacgactgcgctagtattacagggaacggttaaatacagagaaaattctctttctgttttttcccattccacagagatcatcccatacatggtttctttctttgcggaggcgaaccggagatcacctatgggctttggcgcgatgagaacctccttgcatgctggtgaaagcggcacgatccccgttaccttttcgtaaaagcttccgctgatgcttccgaacataggctggttatgacagcaggaacactgatagaacccgtattctttttcccaatattcccacagagccgtagccccgtttgtgagcatatatccatatccgggataggtggtatttgtgatcatcttatatgcagtgtccccatatccgctttccacgagtgtttcaaacagatagggtgtcccgaagattcctgtatccagatgatcttcgcactcatccgcaacgtgtcttgccaaatatctgaagacctgctctttttcctcatcctccacagctcccagtttccaggcaaaggcctccgttccctgtgccccgatactataccggccggtctcctcatggaaaaattcccgacggaaggcctgtatggtattttccttcagtattctgtaagactgcctttcctcctcttttcccagcaccccggcaatattctccatcagagaggcacaataaccgtaaaaataagtattgacaaaccggggtggaatcaaaatctcacccggtgtagaccactctcccagacaattctcatcttccccttctgcttctacgataccgtttcggacacctgttgccaggaactccatccagtgtttcatatttccgaaatgcttcttcagtatctccgtatccccatagtattggtagcataaccaggaaatgataatataggcacagccccaggcgggaccgccgcctccgtcctgacagggtactgtgtgaggtacaaagcctgtcttttcgtcctgggcatccgcaaaatcatccatccaggccgcataaaaattctccatattaaaattatagatacaggctttcgccgctgtcagcgcatccccgccgtatccctgtctctccctgtggggggagtctaaaggcataccgcagtgcattccgtttaacagggaccaacgggaggcctgctgtatctgattcatcagcgcattggaacaggtgaattgtccgtcctcttccacccctgtatgtaccacaacagcctctatgtctttggtttcgggcattttcccccagccctgtatctctgcataccggaatccatgccaggtaaaccggggctgatacacttcctccccgtctccctttaggatatatacgtctttttgctgtttccatccgcttccggtgctgtaataattaatcttcccatccggccacagctcctcaccaaagcgcatggttatggtctgaccctcacagcctgtcactttcatcttcagccatcctgtgatgttctgcccgaaatccagcacatacatatcgtccttgacccttgtgactgtcttgggatgtatggtacctgtcacagtgtcaccggacgccctctgttgtgtcagagtacctcccggctcctttgccggtgcggcatgcttccattcctccctgcgcactcccggccggttccatcccggcagttcctgacgcgcgtcatagatctctccgtaataaatattattatattgaatggggccttttttccatgtcacggaagtatcgctgccgatggtctctctggttccgtcctcgtaatacagctcaatctgaaacaacagcttgggaaatccataccacaacagcttctcattgaccttgtccctctggttgtaccagccgtttcccaggataactcctatggtattttctccatctctcaattcttctgtgatgtcataggcatggtaatatactcttttggtaaattctgttctgttgggcagcagaaactgctcattgcatttctctccgttaaaagagagttcatagaatcccagcccgcagatgtagaccgtggccttttccggtttcttttttataaaaaagtcttttctgaaatagggggcgctcacctggtcctctgcacagatccattgggctttccagtcgcttttttctaaaagccccgcttcaaaaaagtttatctcactccacggagattctttccctgtctcgtcccagatcctcacacaccagtatatcctctctctggagcaaagggcttcccctccataatgtattcccacagaacaggagccttccaccttgccgctgtcccagcacaagccgcggccgtttaaaagctccgccctgctgtgggatgcccagatctgataggctgtttgtcttcgtcctcttccgtcccctgtcatcttccatgccagtcttggattcctgctgtggatccccatggggtttacagaatattcacaggtaagtttttccggtgcataacattttctttccatcataatctccttatttccatcgaatcacaacacccatgtacggggaacggtttttcatcatctctttatatatatctgaagcctcttcgtaacttacgcggtggctgataaggctgtccacttccatctgtccggtggagagcatccggaagaacacttcactattgcgcacacaggtccagggatcatcaaagcttggtgtcactgcctgggaagaaatatgggcaccgatgatctgaaagcttcccgcattgcagaaatcgtgaaaatcaaattttgtctcttttctcggtgaactcagcatacagagttttccctgctgatgcagcatcttaaattcctccgggatcagatctgcattgcctgtggtctcaaacacaatatccgcaagctccccttgggtaacctgctttaccgcatccatgacggattctgtctctgatgaaacggggatcactgccggggatttcggaagatattccagccttttttgggagcggttcaccaccacaatttccgtacaccctccggccagcagataacggaccagaacctggccgataactcctgccccatagaccactacccggtttcccagttcaatctttgtccgtctgatcccattcagaccaacctcagctatggcaaaaaaggctgcctcctctgaggtgatgtcataacggatcatacgcagttcctcttcctttgccgtcacatactgtgcgtgtttgctgaagctggctactcttttgccgatccattcctttgaaaccccttctcctgtctccactaccacacctacgttggaatagcccggagtcatgggataatggatataggtagaccatttggaatcttttgggcattccccgtttagaaaggtaagctctgtgccggtgctgaccaaggacacctctgtctcgatcaagacctctcccttttccggctttggacattccctgtcctgcagttctacatttcctgctgatggaaaaataattgttttgttcatggtaatctctccttttcttatgtttcatatagctcttctgcatttagtatatattttttttgctaaatcttttcttaattattttaccgaaatcctatctatttttaccactggatgcaccgttcatcctcttactataaacaggatacgaaggctggatgcagcactggacggaaatagtaaaaatagacagcattccagtaaaaatattaaatacttttcttctgttcaaggcttataattctaaaatggaatataaaaaagtccagctaagaaatgtcaataggtaaaatgaaaaatgttaaaaaagtttttttcaagcagttgatgtaaaaaagggtaactttaataagcccacccatgtggaaatctttaaaattcatgataaacctgttaggctgcgttctgtatcttgtcgggatgcgctgccagataccgctcacagtgttcctgaggagtgatgatctcaaatggtttattatcccggagcatggcaaaaatgatattgcagattttatgcatgacagccccgacagccacgtttttcttcttgcttttgcatttgtcggtataatagccgtggataactggatttactggtgtttttgtccctttatccaccttaagattattgatagccaccatatgcaggatacgcctggcaaggctagaacccctcttggacatgtggactttatccccattgaacttgccggattgcttcacggcaggatccaagccgaagtaagcataaagcttctttggggaagaaaacaggtcaaaggagcccatttcagcgatcaggacggctgcactgagaaaaccgacaccacgtagggactggagaaggaagatacggtcataaaccggcgtcccttccagcttatcaacagccttatgcaggtcctcaagtatattgtccagatgctcctggtattcccggtaggttttgatatacagtcggatccggagtgcactgctttgaagcgcacgtccgaaaacagcggcgtcctttgcggcagcacgtatggcatcatatttggaaacggcatatttttcaccgaaacgtgcggttttgcgtatggtttccacaagtatgtcttttggggcggcaagcatgtctgcggcaagggggtaagcttccagaagctttaaggaagtttgggtagtgaccttgctaaacaccttccggtatgcaggaaaggacactttcagttccgccgtgagcttcaggacgacagcggactgcaggtctttgaagtaatagtagtcccgtaccaggttgcgcaggtcaatgacctcatcatctggtatgatggaagtcttaagggaagcatccaggccgactttggcagctttttttgaatcaaatttatcattatgcagtttccttacgttcatatttgtgctattcttagtgatgataggattaatgactgagcagtcaaaccccttatcacgaaggaagtacaggagcgggatgtggtagatcccggtggactcaaggaagcagcggctttcgagggaatacatctcttgtgcttcctttatttttgcgacagcaagctcacgggactgcggatcagaatgaatgatcttaaaaggtttcccggtgagaatgccattgggcagcatgatggacatccaggtgaagtctgcaccgacatcaagcccgactgagagataagggatgctttcaagcatcataagtacttttgggtatttcatggttttatcctttctggcaggcatccatttccaaaaggtggatacacaacctagcggtttatacaggtattagcctggggcttcccaaccagccaaaacataaatcaccaccgaatggactgacagactttctaagaggtttcaccagccggaaggccggttcccaaggaggtgtcgtcaatgatcctgcctccagtgattatacctctatcttttgtctggtgcattaaggaaacctcagacatggtaaataatgttactttataacttctgatggagggggaactcctccttccgttatatctatatagatttattagattggactttgtaactattaaccagtagtcattcttgactacaccattattatactaggaggtaactaacattgataaacattggaattataggatgcggcagaattgcacaggtgcgtcatatcccggaatatgatcagaatccggatgcctgtatttacggggtatatgacattaatgaaaaacgggctgaagagattgcggaaaaataccatgcagtctcatataagtcttatgaggatctgttaaatgatgatgccattgacgcagtcagcatctgcactgccaaccattcacactgcgaaatttccataaaggcattaaagtcaggaaaacatgtcctgtgtgaaaaacccatggctgtcacctacgaggaatgccaggccatggtaaacgctgcaaaagaaacaggaaagtatctgatggtgggccagcaggaaagactgtttcccattcacgtaaaagccagagaagtccttcagagcggtgccattggagacgttttaagcttccgcacgaatttccgccattccggtcccgaaaactggacggtagaccgtcagaaagtctggttctttgacaagaaatccgctgctttcggcgccatggctgacctggggatacataaggcagatctgatccattatctgttagacgatgtgatcgaaagcgctgtggccgtgactgagaccctggacaaaaaaaatcctgacggaactcccattgatgtagacgacaacgccatctgcatctaccgcacccggaaaggcgttataggaaccatggaggttagctggacctgctacggccaggaagacaagtccactgtaatatacggcaccaaaggcatcctgaaaatcaacagtaacccacagtaccccatcattctggaaaagcagaccggagaacaggtttactatgatatgacaaactataacccaggccaaaacggttccggcatcatagatgcctggatgacctgcctgaccaccaataccccgcctctgatctccggagaatcttcatttgaatccatgaaggcagtcttcgccgcattagaatccgcagaaaaagggtgtgttgtaaacacagacagcttatcaaaacattcttcagaacaaaactaaatactcactgttcattccactaaaagaagacgccggatacgaatttacccgtatccggcgtcttactcagcaaaactatataattttcaaaatccccttctatttaatggctccatccaccataccctgtatgatctgtttctgcgcaaacaggaacaggataatgatgggtatcatggcaagcagcgccgctgacaagattaaatcccactgcttcacataagagcctacaaaactgctgaccgcaaccggcagtgttttgatccgcccgttcagccccagcatcagggaaggcagaaggtaatcattccagatccagataccattcagtatcagaaccgtcacctgcacaggcttcaaaagcggaaaaatgatccggaagaaagtcccctcaggactgcacccgtcaatccacgcagcctcttccaattcgtaaggaatccccttcacaaatccatgcagaatgaacacggacatggacccaccaaatcccaggtaagcgaatatgatccccttatagctctgcagcatctgaatcccaaaaaagttggaggtttcccggaatgtggagagcagcggcagcatgaccacctggaaaggaataaccatagctgatacaaaaagcataaaaatgaagcttgaccatttggtcttatttctcaccagaacccatgcagccatactggaaaatacagtcagcagcaaaagggaaactgctgtgatcagcagagagctgaagaaagaattccagtaattaaaattctggttatgtattacattgctcagattggtaaagatctgtccccagtgttccggcagggaaatgggacttgtaatgatatccgcgctgctctttgcagagttcacaacgaccaacaggaagggagccaggatgatgactgtaaggatcacaccaataatttctgcgattccggttcttattttttgtgccttcattacatttcaacctccttcttcttactgatggatacctgtgtcagggacacaatggccaggatgataaagaataccactgctttcgtctgtcccagcgcatactggttcttgctgatagccgtattatatatgttcagagccagaaactctgtggcctgtacaggttttcccgccaagatacggctgggcgctccgttggtgatcgccaggtttaagtcaaattgcttgaacgaatttacaagtgtcaggaaaatacatacggtaaaggtattggctatcataggcactttgattttcagcagagttgtgatctgactcgcgccatccacattggatgcttccaggatatccttcggcacactctgaagtcctgtgacatagatcatcataatatatcccgcatactgccacgtgctcacgatcaggatcgccgcaatagccaaattgggatcagtcagcatggaggtgctgccctcaattacagttgtcataaccttgttgaaaataaactgccaaacataaccgagaacaataccgccgatcaggttcggtataaaataagccgcgcggtagaagtttctgccctttactttagatgtacacagaagagccagtccgaacgccaccagattgactgccagcatgttgataacagtgaaaataaaggtcactacaaatgaatatatataatcattggatttaaacatactgatgtaattgccaagtcccacgaacttgtcaaatttgattccgttccagtctgtcatggaatagaaaataccgcaggcaaacgggatcagcactgtcaccgcaaacgcgaagatcagtggaaacaaaaacagcacattgattatggagcggtgttttctggtcggaagcaggtagacaccggctaacacaagcacagctcctgcaatgagaagcgggcctctgaccgtggatgcactgcctgaaaaatccatatagagagctgctgccatacctataattcccgcagccatggcaaagattgatattgtttttttcaattgaacattcatgccttttccccttttttaaatttaccggctgttctcccgggatgtgccccggatccttccgcacacatccttatgaaaaaccgccggtaaaactggttaattgcttccgttagatgctacataatctttgatcactgattccatggtgtctacaaatccctgtttatccagctgtcctttggcatacagctcaaatacagcgcctgtggcattctgcgcgatgccttccggctgtgtaagccagtcccaggcataagttttgccgtccttgatataaggaagcatgctctttgcaagcggtgtgctcggctccagtgtgcaggatttatacggggaaaccattccacagtcctcaaccagggctttctgtccctcttcggtctcagccagtgcctttaagaattccttgcaggtgtcgatcttatcactctcattgtagatgccccaaacagccggtgcatctacaatgataccgtctgtatccgctgttgtgaaagcagccggtgccagtccgcatgcaaactcagcttcatatgtgggcagtgacgggtcgatccagttgccctgtgtgataaatgccgcttttcccgttgcccacagtgcaagctggtcgtcatatgtaccggagatcagcacgttctgatctgagtagtcaaacagaagctgaagccagtctgcgaactctcccattctgtctttgtcaatctcccctgcattcagcttgtcaataatttccttatccgttctgtcttttccctgggaaatgtaagctgccatcatgtggttacctgtggaccagtacatctgtcctgactccgctgccacagcacacacggatgtaagccccagttcatccttcatggaatctattttctcaaacgcctctttgtaggcattgatatttgtcagtgttgacggatccacaccggctttgtccaggatatctttgttgtatgcaagaccgatcccttccagggcaaatggcataccgtatacctttccgtcctctcccttaaacgcatattctgtatcctcgatccaggactctccgtccagcggttccagccagtctttaaaagaagatttgtaggagtctgcagcaaacgcaaagatgtccggcatgttacctgccgcatagtagtttttgagctgtccgttcacatctacaccgccgcccagggattcgatcacaacttcctgtcctgtctcttcctggtactgctttgcaaattctttcaaagctccgtcgatctctatttttgtattcataaaacgaatggcgtctttgctcacatccgctgtatctgtcgtcccctgtgtgttgtcattggccgtgctgctgtcatttccactgtctgaatttcctccgcatgctcccagtgtcactgtcattgctccggcaagtaatgccgctaaaatcttctttttcatttcttttaccaacctttctgaggattctatttttataccttttgcgcataaggttttgatgttttgtatcttaccaccacttacgcgtaaaatcaatgttttttataacacactatggccatttctctatttttcacagaattacttcccattttcctatataaacacttaaatttttgtatatttttaacaataggtttttcgcaaaacctcttttgcctctttcgacatttttatacttttgcgcataagcctttattgtatgacgtctgctgtgatagttttttcccttgtgcatatctgacagaacccaggaatataacaaaaatgccgtatgaccccggaatttttccaggccatacggcatcaaaatttatttttcaattattgatcttttttacagaatcacgaatgatcatctgtgtaggaaggacaaccagtgtctctgcgtcctccggctttccctccagcatttttacaagcatatcaactgccacctggcctttttcctggatatcctggcgcactgtagtgagtgccggccttaccagtgaggcgtattccacgtcatcaaacccggttatagaaatctcatccggaatcttcctgcccctgtcctgaagggtattgagaagcatggatgcatagtaatccgaagcgcatatgatggctgtataggcaaaggatctctcatacagctcctccagattgttctgcccgcctccgtttcccggacatattttcaggaaattttcctcgcctcccgaaagtccggcctcttccatggcctgacagaatcccagataccgctgatggtccaggtttatattattgtcagcaagaaaagcaatttttttatgaccgcatccgatcacatattttgtcatctcataaactgcttttttatcttccagccggatattaatacagtgttccagatcgttggtgtcataatcgtcaatgatcacaatgggctttttgtaacgttcctgcagataggcgatttccccttccacaaatccacaggtcaccagtccgtccatattccaggacaggataaatttctgaacctgccggacatcattcagtgcatagaccatcagattatagcctctgctcctcacgcggtcttccactgcgcccagaagctctccaaaaaactggtccttgaacggattctctctgccattgaccttgaccaccataccaatgatcttagaccgcttactggccagattacgggcattgatgttgggcatataatcatactcctccaaaaccttttggatgcgctccacgttggccggtgatacctcttttgtcttaccgtgaataacgtttgacactgtggtggtgctcacgttcagcatattggctatctctttaattgtaatcattccaaagtccccaatctatttacagtatttctgcagtgatctcttttctgcggcttcctgtatatgtacagttaccgcttctgtcgataacaattttaccataattttcggggttttcatagtctttcccttttccgtcatcctcgtaccactcataagacgcaccttcttttacaaaggcaacagcctttacccggtccgtgtccacttcatcggtgcactctccgccctctgagagcagaaggatcttatccgggcgcaaaaataccagcatttcataaaggcctgccctgacatagtgatgtcctgccggaaggatctccgtatcataatccgtcaggctgtggaaacggagcagcgccatctcctcaggaagatatacataccttccctccgcgttctgtgtataaacaggcgcgatcataaggctgtccccaaccaagagctggtcctccacctgtggcgcaaaagcgtcctctgtgtatacaaaggacaggggcataaaatacatatccccgccaagggcagatttcatgtattcactgtaaatgtacggcagcagcccgtagcggatacccagagttccggcaaactgctccacatggtcaaattggtaaacctcctgcattctggtccccagcgctgtgtgatttctcataagcggtgagaacatggcaagctggatccagcgcattaccaaatcttctgtggtgtcggaaccaaatccgccgatatcagcaccggtgtagaggattcccaccatgttcagggacggcatcatcttcagattgagaagcagatgctgccaccaggacttgttgtccccggtccagataccgccgtagcggtgcattcccacataggaagagcgggaaaacataaggatcctcttgtcaggacacaggcgctcaaacgcctccccggccgctctggtcatattgtagccgaacaggttatgaaccttgtcgtggcgtacatttcccgcgtcggtgttgtgataaaactttttaaagtcatccgtattatttgccaggccgtccaccaggcctgtgaatttctggaacgtatccagatccaggttctttcccttcagcgcagctatggcgtcgatggtgtcatccatacggtcctgggcaaagaaaatgctgggttcgttcatgtcgttccagaaaccttctattcccttttccagtaagaactgatactggtttccaaaccactctcttgcatttttatttaaaacatcaggaaaatgcacctgtcccggccaaacacctgcgataaattccttcccgtccttatccttgcagaaataacccttttccacgccttcctcatagacaggatagcctttttccaccttcactcctgcgtcgatgatgggcaccagacggatattctgcgctttcatatcctctaccagaccttcaaaatcaggaaaacgctcccggtcaatagtaaaatccttatatcgctccatataatcaatatcaaggtaaatgctgtcaaggggcagatggttcttcctgtgtccctcagccacctcacggatatccgcctcgcatttatatccccagcggctctgctggtatccaaatgcccatctgggcggaatatagcttctgccgatgagacctctgaattcctttatgatcccccggatatcactgccctccagaatataaacatccgcatccggttcttccagagtgatcaccagttcatccatatgggtatatcctacatcaaagctgatgatgcccgggtaatcaaaaaagacgccaaaggttgtctcaccggcgatcactaaaaagttgtgggatgcgtacagggaatgtctgtcctccagatggttcggctcatccgcgcagcagctcttgtaaagccatcccctcttgttgatgcccctcacattttcacccagtccatacaccaggtccttttctccaagtctgcaagaaaatgtgagcctgctctcctgctctgtccttttcagatagggcagcgtctccgtttccgctgttatctcctttacaaccgcgtccgtgcagaaaggatttccgtatgtatatttccgtatcatgtctgttcctcctggttctccatatttattctgacatcatagcatatgtgtatttacgccgcaataccttttgcgcataattaatatactatacaatattacattgatttattatggcatgttttattatattctcatttttattcgtctttacgcacaaaatctatgtgattattttagtcccatctttaagttttagtaccatatttctttaaaagttctaaccatctccttttctggaaaccagcttatttactcaatgtcatgatgctggggtcaaaagccctgtctatagaaccttgaaaatttaatactttacagtaaatataagcaattaagacttttatgaattataatggtagtaacttcggaaagatggtatgccctatgtcttttaaaacaaatatttgccagcaattatcattagatgacagttttatgactctttctgaacgcgaaagaaaagctttggaaaaatcatgggcaaagattttcgcgcatgagatttttccggctatagatgaagaacacttttctgtcctatatagcaataaagcatccagacctaatgcacctgtaaatgttattataggtgcactcatcatcaaggaacttttcgactattctgacgatgagattgttgaaaatcttatgcttgaccttcatcttcaatacgctttgcataccacaagctttgcagaacagcggctatcagacaaaaccctgagccgtttccgtaagagatgctatgactatgaagcgcttcatggtgtggatttataccaagactgtgtaaaagacctcagtggcaaaatggtgttagtatataagtatggacacgaaaagttgaacaacctataatagtaattgaaagagtaaaggagatgttcaacatggcgaagaatcaaaaacactacactctggaattcaaacagcagatcgtaaatcagtacaatgccggaggaacctcgtttccacaactgtaacgtgaatatggcgtaaatcggagtactctcagtggctggataaagcagctctccccattaaagtatcagagaatgagaccgttacactcaaggaatacaaggctttgcagaaggagatgtagcgcctgaaaatcgaaaatgaaatattataaaaagcgaccgccatattcgcaaaagaacaataaccgaaattgtgacttttatccagagtaaccttgaatattataccgtttcccagctttgcagtgctttgaaatttccctgaagcacctactacaaagctctggtccgtgtaccttcaaaacgccggcaaggaatacactgcattcaaccagaaggtaaaacaggcatttgatgaatcgagttttgctatggggcagtgaaaatctgtcgttccctaaatgatcatgggactgcctgcagcctgaaacgcgtgcagcggcaaatggtggcacagggacttcgctctgttgtggaaaaaaagtataaccaccttgcgaataacgctaaggtgccggaggacaaggaaaacatcttgaagcgtaattttgaagcggcctccatcaaccagaaatggtgcacggatatcacctatatttatatattaaaagaagactggacgtatcttgcttccgtgatggatttatgcagccgcaagatcattggttatgcctatggaacttccatgactgccgatctggctgtagaagccataaaaaatgcctgtctgaatgcaaaagatacaaaagggattatccttcacagcgatcttggcagtcaatacacaagctaggcctttgaggattacctgtccgaaaaaggaatgatacattccttcagccgtaaagggaatccatatgataatacatgcatagaatccttccattccgtattgaagaaagaagaaatctatctacatacataccaaaacttcaaggaagccccgagggcagtctttgaatatatagaatcctggtataacagaaagaggatccacagtgccattcattatatgactcctcagcagaaggaggatgaggaactaaaaaagatggcataatctttcaactttttttgtccaatgtattgacatatgtccaatttggggattgagcgcaattcagaatatgcgctggaacaagtttacaacgtcgtggacagccgctatttaagccgtctgccgttcattatcacgacgaacttacccctgccaagccacaagcgcccaaggatttagcacacgcccgaatatatgaccgcgttcttgaacgttgcaccccagttatcttcaccggcaaaaaccacctcaagaacaacgcggccgccagcacgacacccgccccacaagagggcgcgcccgcccttctcaagaaaatcggcaagaccacctacaaggtgcgctctcatttcagcaccaccagcaccgaaaccatgagtgacaaaatcaagcgtatgttgcgcaacgagattcagcagatgtaattcattgttcttagccacagaaaagttattgggaagtgcttttgacagctactccccaataactatatggctatggattcattctttaaacgcacagcttcgactataaatccaaatggtcgttttccagagttaactgtttgtaaatttctttgcattttcctgcgtttttaaatatattagcagggtaagaatcagcataaagcgtgttcatctgtaaaataatttgtggtagcttttcgttaattatcgatgttataaactcgtcgagataatccgattccaaaatagctttctcataattagggttactttttatcaattgaattacacaatatgaaataaaacgatttgcgtgtacgcataccaaacgttctcggccagttgcttgttctttcttaatttgtaaataagcctctgttttacgtattatctttacactattgattagaacgtaagaatttgttcctgagttaaataaaactttataaggcgctttgttaatatcttcagataagccaccgacgttacgttttgcaagagtcgcgtatgacaattccccatgccagcatgctaacgcaacaatggcctcatcaaatgaaatttgatgttttgggtcagttaaagtatcgccactcttatataaatagagaatgtgtgcaaaagccaattctgtacgtagccgctcctgttgaaaatcaagtgatgcaaaatctttgctatctatacggttttgtgtattggataatttcgtaatctgggcaactgcatcatcagttgcattactaaggtcaataatttgaatcattacattagcctttgcaacctgttcaggatcttgagcataaacactcccaattgttcccgtcgtttgtgccccattaaccaaagaaacacctgataacgagaataagcctgttacagtagttgtgcttccttttgctttccgttctattgtattgcaaaggacttttatcccgttattatagtagacaaaattttcgggttcttgcaatagcacccgtttaattccatcgttcacgtctgtactacccttatagaacctaatatttttagcaaacaaggagttgccatatgtattaaaccattctcccacggcggcagctgaaattatgccatagtatgctgaatatggggcatctattttcccccagttgctgagaataacatcatctaagttaatagtctctggattttgcccttctgccaaaaaagcatagatttctctaaatgttaattcttcaaaaagcagcagcgtacttacatcatcattagtagtagacatcaaatctgttaatggacgttttgcgtaatccggaatatacgtgttgccagtatgagtgaaaatcaaactaatttgatatccaatttggctaattccaaaatcaatatcagtttttttggctaatattttttgattagcgccgtccaagtcaaaattaagcagtcttcttattccctcaataaaggtttgcatttcctcttgggatattgacccatttccatcatttctccacttgctttgtactacaaataacttcttttgtgagttatcgagatacaaagcatcaatccccaaatcgtggtatccatctgtaatacaacgcccagcttgttcagtgtccagaccacactttaacattagagtcaatgctgcaattgcacgtgtatcaaattgatttctgatgttatccctgcaatctgtcaagtcaatctttccatcaaacatttcttttagtcttgtttgaattcgcagaatgttaatattagccattttttactctcccacttaaacttttatctttagtgatgtgtcacctatatctgattatttcaatgtaatcattatacaactaattcgacccattcgcaactttacagtctatttcccaggccccttaccaccttgatatttgaatgatgtgtaaacttgattagaaagtcgttgacaattcatctctggaaaagcgagttgttacttttaaccccggacttgccaaaaaacaagtccatgagatcaaccggcagattgaaaaagcaagggcattaaaagcttgtcaggcaaaaaaatcagaatacggagactgagcaaagtatatgacgtttattaccgctgataaaaaaggaaaagaaacagatgggaaagtaatgctcatcatgaatgatgaggccatcaaaaaaaatctggaacttgccggatataatctcctcgtgacatcagaaaccggtatgagcggttcagaaatttattccacctatcatcagctatggcggatcgaggaatcctttcggattatgaaatcgcagcttgatgcaagaccagtatatctacaaaaagaagaaaccattacaggacatttcctgatctgttacctcacagtcctattgaccagactgctccagatcaaagtgttgggaaatgatccctgttcagaggaactttttaactttttccatgacttcagagcagcgaaagtagcagacagaaagtatatcaacctgacaagaaagtccgactttattacttcctttgcaacaaggacagacctgcccttaacttcctattttttatctgaatctcaaattaaaaagatgctaagccacaggttttagactgaggtttagcatcattttatctattcaactcttaaagacaggtagcatatgtgtatttgcaccgcaataccttttgctcataattaacaatctgtacaatgctgcgttgttttattatggcatattttattatactctcattttttattcgtctctatgcaaaaaatccatgcgattattttagttaaaatagtatggcagtgagatttcaaaattcggcagtgaggcttcaaaactttttctcgcagtaaaatggggaacgtacactcatgtacgctccccattgtctactctgtctcttaactttaagactcactgtactccgtctgtattctcatctacagtaccggaatattcaagcatctcattttcctgctgctcggcttccttctccctggcttctttttgtcttaaataatacttattaaacggaacctcaccgtatttctccagggctttctcttccccgtatttttccacatactcctcaatggtcagatcatcatctgagacagtatccgcagagtcagtatcctgttccttttgttccggcatctcctgttctccgctgttggttcccttgtctttcgggtcagatgtttccggtgcattgggactgctctttgcttcgccggaatcctttcccggttcccggctggcatcactttcttctggtgccgtcacagacaccggttccttctttttatctgcatttactgctttttcctctttcccggcttcctccctggtttgctcctctttttctgacttgccgttctcttttgaagaacatcccgtgaaaccggcactgacaaacagaagcacagccaagactgcagtaaagacagcccctctttttcttatcattattgtactcctccctttttctctacaaatgtagtatttatatatatactacatttgcagtagggaaaagtcaatctgtattttattatttttccatgggatagtgaagtccccatttttcacggacagcatccatctgctccatgatgcggatagtctcgctgtgcggcatatccgggcattcacagagtccctcttcaatggccattttgcaggctctcacctcatactcatagccgcttatctgcctgggctgttcatatcgggcagtcacttcacggttttcattgtagaccgtgatggactcaaaattattgatattttccactacaagaaaaccttttgtcccgtaaatgatcccctgtctgtcagaaagcgcacgcagagagctgttcagcacagacatcttcccatccgggtaactgagagttacgctgctctgtgcatccactcctgtgtctgtcataatgactgaagtgtcaatggacgaaatatcatctccaaaggcaatggaggcaaacgtcatggtatagacgccaacgtccagcagggcaccgcctgccagctcaggcttcatcatcctcggaatactctccaaaaggtaccccaggttagcagtcagggtatagggtcttccaatggcgccggaagagatgatctcctgcagcgtctttgccatgggcatatatctgacccacatggcctctgccagaagcagccccttttcttttgcaagctctgtcatttccctggcctcccgtgcatttacggcaaatgccttttcgcacaggacattcctgccgttttccaacagcatttttacattagcacagtgttctgagatcggtgttgccacgtaaaccaaatccacattttcatctgccgccatctcttcatatgtaccgtaggctttttcaaagccgtattcttcagcaaaggcctccgccttttccaggcatctggaagccgctgcgtacatctccacatcctccatacaaccaagtgtcttggccatggtcgctgcgatatttcctgtactcaatacacccactctgatcttctgcataccagtctcctcctgcggtcttcatccgccgcctctttatggtttcaccgcatattttatcacgccatcctgtttctgttcaaatacttcatatgccttcatgatatcttccagacgggtcctgtgggtgatcagacatcctgtatccagcttcttcgccgccagaagctccatgatctcctcacaataactgccgtccacaccgcctgttttaaaggtcagattcctgccgtacatccgtggaagaggaaggatctgatccgtctcatacatggcaacgatcaccaccaccgcgtttggcctggccgtcttccatgcagtctcaaaggtatctgtcccgcctgcggcctcaaataccacatcagcgccccttccatggctctcctccaggacacgctgcaccacatactcctgtacttttcccgcggcatccgcatagtcctcggcgccgcggcggcaggtctcttccgcggaacatatgaccacatcggcaagcccctgctcttttgccagcttaagcctgctttcatcaatatctatggcaatgatcttcgcagggctgtataaacgggcacacatcatagtacaaagtcccgtcgggccggctccaaggaccaaaaccgtatccgccggtttcacttcccccagttttgcagcccagtagcctgtggaaagtatgtccccggtaaaaagcgcatcttcatccgtcacatggtccggtatcctggtcaggccatgatccgcaaagggaatgcggcagtattccgcctgtcctccgtctatgcggcaccccatggcccagcccccattctcattctcacagttgttcacaaacccccgtctgcagaaaaagcactccccgcagaaggtctccacattgactgccactctgtccccgggcttcacttttttcactgagcttccaatctctgtcacaacgcctacaaactcatgccccagaatagttcccggcactgccctgggcacggccccgtgcttaatgtggatatcactggagcatatggttgtaagtgttacctttactatggcatccccggcatcctggatcacaggaacggggcgttcctccagggacactctgccgtttccctgatatacaacagcacgcattttatctctctgcaaatcctccacctctatccaagagtatctaactcatccatccagatcctcacagacgcgtcactgggcatgcgcagatcccctctgggagatactgccacacttcccacctttggtccgtccggcaggcaggagcgtttgaactgctgtgagaaaaatctccagtaaaactttttcagccatttcagtatcacttcgtcatgatacataccggcaaatgcgatcttggctatccggtagatttttgccggaccaaactggaaacgcagcatataatataggaagaaatcatgcagctcataaggccccaccaagtcctctgtcttctgtgagatcacaccgtccaccggaggaagcagctccggactcaccggggtatccagcacatcctccaagattgccgccagctctgcctccccgcaggtatccgcgtaatagcgcaccaaatgacgtacaagggttttcggcaccgaaccattcactccatacatggacatatgatccccgttgtaggttgcccacccaagcgccagctctgacagatcccctgttccgatcaccagaccaccgcagctgttggcaatatccatgataacctgggtcctctcccttgcctgggcattttcaaaggtcacgctgtggtcctcatagtcgtggccgatatcctcaaaatgctgcagcaccgccttttttatgtcaacctctcgcaaatcagctcccagccttctggtaagctcgcaggcatttgtataagtcctgtccgtggtgccgaagcagggcatagtcacagccgtgatctggcttctgctcagaccgcacaggtcaaaagccctggctgtcacaagcagggcaagggtggaatccagaccgccggaaatgccgaggactgctgctttacatcccgtatgatccagacgttttttcagtcccatggcctgtatggtgaggatttcatcacatcttctgtctctgtcatttttgtcgtccggtacaaagggactggggtcaaagaaacgggacagaggcgtctgctcctccttcacatggaaataaatctgggtatactcctccttggattccggctgccaggtggagatccttcttctctcgctttccaggcgatccacatcaatttccccgtaaatggtctcattggcaaagcgttttgcctcccgcaggattgttccgttctccgcaatcatgttctgaccgccgaacaccagatcctgggtcgattctccgttgcctgcggttgcatatacatatccgcatatgagacgcgcagactgtccgctcaccagctctctccggtaggcatctttcccagtggtctcatcactggctgagagattgacaataagagaagctcctgccatggcatgaaaaatgctggggggattgggtgcccacaaatcctcacagatttctgccgccacacacagcccgggtacttccacacagtggaacagcaggttctggccaaagggaaccttttccccctgccagtccacatacccgtcaaaggcctggcccggcacaaaatatctggcctcataaaattcaccgtaattcggcagatggtgtttggggacaaatcccagtatcctgccccggttcagaactgccgccgcattgtagagcttgcctttatgcttcaggggaagaccgataaagatcagtccgtctgtatcctgaagttctctctggatcgtcttcagctcctcctccgccctgtgtaaaagagtgccctgccagaacagatcctggcaggtgtagcctgtcagacaaagctccgggaatactatgatcttcgcaccgttcttggccatttccctggccttctccacaatctcctgcctgttatgtgcacagtctgctaccagtacatccggtgtcgcggccgccactttgataaaaccatctctcatattgtacctgacctttctctaccctcttttgcagcgttttaatatacttttcagttcttccacagagaatatataatttctgttgcagaaatgacagttcagctctatctcttttccttcgtctatcatttcctgcagctcttttcttcctacactgatcagcgctttttccaccctgtctttgtcacagttgcagtaaaactgtgtggggatggtctcattgatctcaatatcaaagcctttcagcagtgtctccagcagagattcgggtgtatggccttcctccagcattgtggtgacagaagtgacgtttttcagattttcttccaactgactgatcaccttttcttccgtaaaaggcatgagctggatgataaaaccaccggcctgtttcaccgtattatctttttccatcagaacaccaaggccgacagaggagggaacctgttcactggtggcaaaatagtaggtcagatcttcggcaatttcactggtctgcagcacggtctgtcccacatacggctctttcagccccatatctttgatcacgttcatgaagccaacgcctacggccccggccacgtcaagctttcccttgtcatttgcgtgaagaatgacattgggattgccaacatagcccttcacgtttcctttggaatctgctgtcaccgtgatgccctctaaagggcctcctgctttgacctgcagggtcagcagatctttctcgcctttcatcatgacgcccatcatactcccggctgtcagaagacggccaagggctgcggttgccaccggacttgtgttgtgtgctgccctggcgtgctccaccaaatctctggttgtggcggcaaaggcacggatctggctgcccgccgcggttgctcttactatatagtctgccatgttttttctccttttattatagctctcttattttccgcattcctgcgcaatgacatagatgcgttcactgtccgtctttacaggactgcgggtaaaggcatcataagcggcaaggaatttcatgccggatgcttctatgaggcatttgatctcctccagggtataggctttctggtagtggacctcctcatatttgcggtagaggatctccccgctgtgttcttccgggatgaaaagggagagatcgtattcattgatgttctcctcctcgtcaaaatagttatcccagataaaactggcgtcctcccggtcctccgctatggtctgctcacccagtatctccctgtatttgtagggggtgttcaaatcaaacaggaaaatgcctcccggatccagatagttgttcaccagacggaacacttccagaagatcttctttttctgtgatatagttcatgctgtcacagatggagacaactgcccgcacagtgccgtaaagctcaaaatcacgcatatcctgcagaagatagaggatatcctggtcatcctcggcttttttctccatggcgatctccagcatatccggagaattgtcaacagctatcatgtcatagccggcggatgacaggatcctggtggcattgcctgtaccgcagcctaattccaggaccagtccgtcttctatgttatattctctcaaaagcccggtgagatatgcacaccactcttcgtatggaatgttgtccatgaagaggtcatacacacgggcaaagctttcgtaggagctcatagggttcttgtgcctccgtatttttttcttatttatactatcacgaaaagggggtaggtgcaagagggggggcggggaatagggctttgcaccggattcccctggttacggctcacagaatgactgtaacttcccctgctttttcaccgggtgcagggctgatagatgtgatgataggatcagaggtggaatcaggccagtttttctttaaaaaactctgtgatcaagtcccagatctgtctctggaagaattggatatccgcgtgatctgccccttctattccaatgagttgtacatccgcccctttttcctcaagggcatcatacatggcttcactctgggaaaagggtaccgtgcggtcgcagattccgtgcagcagcaaaaatggcggtgcctgctctgtcacatagctgaccgggcacgccttcagagcttctttttcatggcaggcagcgttcatgcctatcagaagtgactcgggagcggactgcatatctttctgcacatttacaggcatcctggtgatgtctgccggaagataccaggggcaggctgcctgcacagcgctggaatattccagatagtcacctgtatcaaattctttcctgtcccctgtcagtgcggccatggcggtgagatgtccccctgcggattctcccatgacaccaaaatgctcactgtcaatgcagtagcgctctgcatgtgctctcaaataccggatcgctgcctttacatcctggagctgcgccggaaagaccgcttcattacttgtcctgtactgtacactggcaaccacaaatccctgtcttgccaaatctgccagataagcaagatgggcgcttctgctcatctgctgccaggctccgccgcatatccagatgatacacggacttttttttctttccctgttcgggaaaaatgatatccagcttcagatctttggtggtgtgcccaaaccagtcgctcacttgggcaaaagtgacattggtgtccacgatatactgagggtctgtgattgttacctgaattgtttttttcattatggggtcctcctcaattttttacttgattttattttatcacaatagaagggattggcaagagatatgttggtataaatgggacgggggatccgacgcggcggtgaggaggggctgtccttggaacgaagcgtttcgctgtccggaagctaacctgctcccagtcactaaattcgtcggcaatggcctcctcattaagtgtctggggcaggtggatcttccgaacgctcatctgaacatcgctccaaggacagcccctccccaccgccgcgtcggatccccctggtttttggctgcccacaggggtgtgaggtgaaaattcctctcccgggagtaaagataaaaaagagataaatcgggagaggaattgataagaattgataaaagaatataaattgtagttgtgaggacattaccgacggttaatgggttatggtcatggcaggagggtgaattgggttttgttggtggtggtgctgtcggtgcctatgtagaggtcgaaggtgccgggttcgctttctgtaagggcgtgttcagtgaggaagcaaaggtcccggtcggttatgtggaaggttactttttgggattcacctggctgcaggtggatcttacggaagtgtttcagctctttgacgggacggacaacagaggcggctctgtcatggatgtagagctggatcacttccgttccgggaagggagccttcgtttttgatggttatggatgcctggatggtttcggttttggtcattgcggacttgtccagctctatgggggagatggaaaaggtggtgtagctcaggccgtatccgaaggggtataagggggcgttggggatgtccaggtatttggaacggaaacggtctttgtcagctccggtatagggacggccggtggagtattcgttgtagtggacagggacctggcctacgcagtaggggaagctcatggggagttttccactgggactgcaggtgcctgtgagaacgtccataactgcgtgggcgccttcggttccaggcatccagacctgaaggatggctttggctttttgggacagttctctgatatccaggggtcttccggagaagagaaccactgcaatgttctgatttacttcatatattttgttgaaaagggtctgctggatctcgggtatctgtatgttggcgttgctggtggcttcaccggattggacgtagtgctcacctaagggcatgatgacaaggtctgctttttttgcggcttcaatggcttcttcgagcattttgtgctgctgttctaaggaaacggattcttcagtctgctctgtgaagccttccagatggatgtcgtttccgagtattggacagccgggatgaaatgttgcttctgtgttgtctaaggattccagagctgcctcccggatggtcagggtgtcttctgtatgaccgatgaaggaccaggagcctgacatactgcggttgtctgtataagggccgatgaaggcgatgcgctgtcctttttttatagggagggctgattcatttttcaggagcacgaaggatttgcaggcagcttccctggcaagagctttgtgttctttgcagagaatgacttccttttccttggtttcgtctgcgtctttgtatgggttttcaaagaggcccagtttgtttttcagctccaggatgcggaaaactgcctcgtccaccagttcctcatccaggattccctcctctatgagagatgccaggttctcggagtagatgccggtcatcatgtcaatgtcaacgccggcttcggcagctctgacggcagcttcttttctgtcttcacagtagccgtggtaaatgatctcctcaatggctgcccagtcggatatgagaaccccgtcaaagcccatctcctctctcaggatctggcgcatgagccgtttattgccggttgccggaactccgtctatggtgttgaaggaggtcatgaccagggccgcgcctgcgtcaatgccggctttgtaggagggaagataaaattcacgcagggtatgttcggaaagctctaccgtattataatcccggcctgccgtgggggcgccgtaccctgcaaaatgcttcacacaggctgctatattgtagggcgctttcaggtcatccccctggaaccctctgaccatggcctcggagaagaggcagtttaaataggtatcctccccggtggattccatgactctgccccagcgggcatcccgaaccagatccaccatgggggcaaaggtcacgtgaaggccgctgacagccgcttctttggctgcggctgcggctaatttctcggacagctccggctcaaaggtggcaccctggcctaggggaataggaaatacagtgcgaaaaccgttgatgatatccagcatgaagagaagcggaatcttgtgagggtgtttttctatgtagctcttctgaatctcttttatcttcgacgcgccaaggacccctaaaacagatccggcctgggagatgttctcctctgtgaagccgctctccttcatagggcctgtgatgactgtgtcgtccatgtaaaaattaccggccacctggagcatctggttaactttttcctgcagtgacatatctcttaagagttcttttaactgttgttttgtcataatctttcctttccgttttaatcgtatatcggtaactattcagtaggtctgcgcatttactgcgctgaccgtaagaaaacgtccagcggccaggcaaaaatcccatcgccgcaggcgattctgcatggatttttgctcgtaactgtgagggtactgaacagttacgtataacgttttttaaatcactgcctgttcaccggcctgattttcccacagcacaggtgtaaaaacctccatgtatactgatgcgcctgcattttgtgtctgcattctcgaaaatcattctcaatgaatcatgcagttatataatttacgatttactagtactacagcgaacgccatatgataagctatatgcaatgaaagccgccccgttaatcactcaccttccgttcgcgaaaaccaggaaaaagcagcggtcttggtggagactggcattgggttctgcgaggctaagcggaaggttctacgaaatccacgatttacgcagacttaggcgagaacgtaagtgagcgccttagtcgtagttaatcgttagttcggaggttctggagcctcgagcagaacccaatgccagtctcccccaagaccgctgctttttccgtcccctttccgcacctgttcgctgtagtactagaatgtgtttgttttaaattttctgcggtattccagaggagagcagcctgtgttctcccggaacatctttgtgaaataggagaaattgctgtatcctacatagatggaaaccgtgttgatcggcagactgctctgggtcagcatcttttttgcctcctccacccgcttctgcatcagataggcactgatggatatgcctgcctcttttttaaagattctggacatatagtccacattcagatataccagctcagcaagggtctctcttctgatatcctcctggtagtgtgtgtctatgtattccttcagttggtctgccacagattcacttttgttgatgtattttgtgtactctacggccctggtcaccaggtgggaggcaaactgtatggcaccctccacactctccagggcttcctggtaatattgctcgttctcacttccggcaaagagcagatgagccttgatctccctggcggcaagccaggaataggtgatttgggtaatatccatacgaaaacttttcaaaatgtcacgtgtgatcagttcccgccctgcaagctctgtgaggtactgccgcatactgctgatgagggcttccggtttctgttcacccaggagggtttcccataccgcccgctgtctattctgataggaaacacatggctgccggaaatcggacagaaacaggactttatcccatactgtaaggctgttgtcccgcatggcctgcagctgcccgaggcagtcctccagaacgtctatctcggcactgcctccgactccgcaccagatatccatctgcatacgctcccccagaatatcccggaaagaagaaaatacaccttcttcgctgagtctctccaaaccccaggcagtgccccggcatataaccgcatagctgtctttccggcaggaggaaactgcttccactgccacctgatattctcctgccagttcccccagaatattctttataataaagagaagaatgttctcatcccagtgctgccttttctcccttcccctatggccggacaggtgcaggagcgctgcaaggaacttatcctccggtttatagtgaagctgtctcttcctgatctcttcctctatggctgacggctttatcctgccgccaagcaattctgaccagaaattattcaggaggatttcccggctctcttcccaatttctgctctcctggcggaaagcctcataattcagggcttctttagcccggtcggacgctttcttaatggcagcggtaagtttttcaaagtcaatgggtttcagcagataatccacactgtccagagcaatggcacggcgtgcgaagtcaaactcggcatagctggtcaggaatacggcctgcacctcgtacgcctccctgcgcacccactccataaaatcaaagccgctgccttccggcatgacaatatcgctcacgatcacatggataggcatcagccccatgaccgtctgagcctgctgcatggaggatgccgtgtagatctgcccaatatccagcagatcccagtccacatttttcttaatactctctatcacgtattcctcatcgtcaaccaacaacagattcataagtacctccaaccgttttgtctgctacccctgagtcaccgtttttctcatgtccccggaaaggaatatgtatgtcaacaatagcgcctccaagagggctgttgtcaaaattgatctccccctgttctccgtaatagtaatggaaacgcttcaggcagttttcaatccccacatggctgccgttttcgctgactccctttccctgctccagcctttccagaacagactttggaaatccccttccggtgtcggaaatatacagattgatgtatttcccatcctccctgtcctccggaaatgctgtgactgagatcagtatcctctcctccagcgtcagcgcgtgttttgccgcattctccacaaagacttgaagcatgaagggaaatatctctccatcctccacctcttcctctatctcaaaatagtattcaaagctgtcgggatatcgcagaagcagtattttcagatagtcctcacagtgcgctgcctccgcctttacaggcaccagaccgctggtgctgcggaagacatactgcagataatctgaggtggtctttgtcatcttcctggcattgccgtactgtttgaaatcaatcatactgtagataaaattcaggcagttcagataaaaatgagggcgtatctgcagtttcagataatccatctctatcttctgcttttccaactcctgctcgtaaagggtgatcttcagacgccggatctgatgtatcattctcttgaacttgtcatcaatctgctccagctccatcagattattctctgtgatatggaaggtatagtcatcgtcatcatactttgtcagattatccgtaaattgccttacaggctccaacagatattttttcaagtatagaaggattgccgccccggccaggaccaatgctgctgccagaaccagaagaaatcccagactgcccatcatgacgcccattattttgtcccctgatatcttcatctgaatgccaaagggcgcctgtttcagcgttctgctaagtgaatatccgctgtttgcctcctgtggatccgtcccctgctctatgcctttgctggtgatctggcctgccacccggttctccgcgtccaccagacgcacatatccgtcgtcccccacgatcgtgtcagtgaaaggctccagtatgcttttcacatttacatagcagcccatgtaagtatcctggttctgggctattttgcagatataattttcctcgccgcagtccatttggttccatttctttttgaccgagtaggaggtatctgtgatcagcccaatctggttcctgacagcttcctccaagtcgttgtcaatatcatatcccacccctgtcatagtgagcatggtgaacgtatcattttccttcagatacaggaaaaagtggtattctgtgccgtattcccatgcatagggcaggcagatcctccgcagattgctgactgcattgtttatttttacaggatcgtccgaatgctccattgtctcaatatagtcccccaatacagaatatccctggttcttttccatgatattggaaaacaggctccggctgatccgcaggaaacggttgtccagctcatctgtatagagctttgacatttcatccatctcctgtatggcctgctttctggtccttccaagcagcatggcgctgacacccgcgtatacagccagcaccaccatgagaatgataagaatggctttcatctgctgggccatatttttctgttttctgtatttcggaactttcgtcatatgctttttatcctttcactgcccccagagtgattccctccgagaagtatttttgaaggaatggatacacaataaacagcggcagcatggcaatgaaggcaattgccattcggatggaggtggtgggaagctttgcaacctccgcgccaatatttcccacgacttttccgcttgcaagatattgaatatccgtaatcatctgattcaaaaggttctgtatgccaaacagcttctgtccctggtttcctgataaatagtataaaccattggtccagtcattccaataggcaagtccggaaaacagtcccatggtcacaagaatgggcttgcccagaggcagcaccacactggtaaatattttcatatgccctgccccgtctattttagctgcttcaaacagagcatccggtatgcttgtgataaaatagctgcgtatcataagcacattgttggcactcaaaagcagattcggcagaagaagcgcaaaaattgtatttttgatatgcagataattcacatacatcagatatgtaggaaccaggcctccgttgaacagcatggtaaaaaatacgaaaaaggtcagtgcccttctgtggggaagcgtctttattgtcagcggataagccatcagtgccgacaggctgatattcagtatagtgcccacgatcgtgacaaaaatggtgactccatatgcacgcagtattttttctccctgtttgattatgtactggtaggcgtaaaggcttaatttctcaggaaaaaatgagtagccgttgcggatcagtgtgttttcatctgtgacggaagagatgaacaccagtataaaaggcagtacaatgatcaatgtcataagaatcagaattatattgataaaaaactgataccgtttttcttttgctgaatttttcattccctctcctcctaaaacaatgcctgttctttatctacttttctcaccacccagttgctcagcataacaatggcgaatcccacaatggactggtacacgcctgccgcggaggacatactgatatttccccgctcaatgagtgcccggtacacataggtgtcgatcacattggtggttggaaaaagaactccggaattcataggcacctgataaaacagtccgaaatccgaataaaaaatacgtccgatatttaacagaagcagggtgataatggtgggtaccagacttggcagggtgattttcgtgatctgctgccattttgtagcaccgtccagactggccgcctcatagtaggaaggatcaatgccaataatagaggcaatgtagatcagacatccgtatcccacacctttccagcagttggcaaataccaggataaagggccagtatttcggctgctgataccactgcaccggctctcttcccatggcgtttaaaatcgtattgtttatcaggccgttctcggaactgagcagtgcgtaaacaatgtagctcagaattaccatggacatgaggaagggcagcagaatggcgctctggtatatctttttcattttattgctgcgcacctcgcagatcaatatagccaccgcgatccctactatcatatttacagcaatgaaggccacattgtaaagcagtgtatttctggtaatgatccaggcatcctttgactggaataaaaacttaaagttatcaagaccgcaccaggggcttgcaaatatgccttttgcaaagttcagcttcttaaaggcgatcacgattccacccatagggatatagttgttgatcagcaggtacaaaaggcccggcagcatcatcaggtataagggccagtgctgtttatagacactgagcctggattttttcttcatattcttcctcctctgtcttatgaatggtttctttcgggcaaaaaggctgccgcactaagagcctttcctgtttcctagggcgacagcctgctgccaaaaatgatccggtctatttattgttgctgtccacacaccgccggatagataatgaacagtaactatttattctcttccagccatttgtcaaactgctcctgttttgcctgtatgatctcatcaataccggctgcctccagagcatccaggaattccggcagatacgtttcggggtcagcggaaccactgttcagtgaaccagtgtactgttttacaacattggcaagcgcagcgacctgactctcatactgggtgttgtcaaaacagaaaccaactgcctttgactcttttgcggaatcgttgaattcctccatcttctcccagagctgcgggtcagagccagtccatttatgggcgatgaactgatttggcagttcccagcccagattcaggctgtatcccacattgtctgcagtgatgccctccgggtagttgatgatgccgttctcctcatcctctatgacataatccacaccttcttcaccccagttcagcagattcatgatctccgggctgccatagatgtaatcaagggtttccatggtcttctccgggttctctgaattctgtgcaacggagtagataatgccgttgtaggtctggcagtttttgatgggataatccctgaacggaacgatttcaaagtcatatcctgttgagcttttaaattccacaggtgttcccggatgataggcaaaaaacaaggagaacagattgcctgccttgcagactgtacgccagttttctgtgtcagttcccgcgtccttgctgatatatcccttttgataccagtcatagagcatggaagtagtctctttataccagtcgctggcaaagaagttggtaatggtggtatcattttcctgatccatgagcacgccaaggtagttggcatctgacaaggggtcgcccccgaacagtcttgtggccggtgtatctccctcattgatggaaaacagcatggtcatgtccggctctcctgccttgactgtctcaaatacagattccatatcttttggctctttgatggcggatgtgtctatgttgtacttctccaccaggtcttttctcatgaagacggcagggatgctgcctcgttcgatctggtttggcactccgtacataaaaccgtccactgtgttgctgttcagcacctcttcgccgtaaatatccttcagatttttgccgtatttatccaccagctctgacatgtccatgatctgtccgctgtgcatgtactggatggcattggtggcatttgtataaaaacagtcaatcttttcatcacctgcaagcatgagctggagctgctgtgtggcactggcccagggaagcactacaatatccagattggcattaacttccttttccagaatctcattgatcttctcctcgatccgctcttcatcagcgggctggctgccctgcagcaccatggtcaccgtgtagggttcctttccgtcctccccggatgctgtcttcttgccttcgctgccgcttccgcctccgcaggctgccagtgacaataccatggccgctgtgagtacagcagctacgatctttttcttcatgtgatttcctccttcacttctgttccttttatacatccatcttattcttttccctgttccttttctataactggtctgacttaaaaatatcactcatttgacacctgaatacgtctgaagacgtgaatgaaaagtttgcgcctgatattttcactcaacgttttctatattataacgtaaaaaagacctgtatacccagtttatcacatggtatacaggccgttccctgttcttataaaacaacaaatataaataattttccaatatctacacagttacaggtaaagagccatacagaactgccttcggcgatgggatttttacctgactgttgaatattttcctgcgggcagcgccataaatgcgcagacctgatggatcgttacagatataatcgctgtccgtcttttgttatattttaaataaactgatttgccttttcatcataggcgtaatcaatggtgcccagctttttctccagctcttttctgtcaagctgcaaatcttcgcacatgtcatccagggaggaatagaaatccctcagtttcatgttcgcaaagctcaaaagcatcaccggatcttttggtatcataatctctctcacctcttatgccctgcgggctgtaagttcaccattttccacatctatgacaatggtgtcctctgttcccacattgccggagagaatgagttttgcagtcagtgtctccacgtatttctgcaggtaacgtttcagaggacgagcaccgtagatggggtcgtatccgccctcaataatataatcttttgcggcatctgtcaagcgcagagacagctcctggtctcttaacctgcggttcagatcctccaccagcagatccacgataccgccgatattctctttagtaagcggtttgaacatgatgatctcatccagacggtttaagaactccggacggaaatgcgtcctcagatctctctcaaccatatctctggcttcctggctgatttcgccgttaggctcaatgccgtccagcagataggtggagccaagattggatgtcatgatcaggatcgtgttcttaaagtcaacggtacggccctgggaatctgtaatacgaccgtcatccaacacctgaagcagcacgttgaagacatccgggtgtgccttttcgatttcatcgaacagaaccactgagtatggtttccttctgacagcctctgtgagctggccgccttcctcgtatcccacatatcccggaggcgctccgatcagacgtgacacggaatatttctccatgtactcgctcatgtcaatacgcaccatattctgctcgtcatcaaagagtgtagctgccagtgtcttggcaagctctgtcttacctacaccagttggtcccaggaataagaaggagccaatgggttttgttgggtccttgatcccggctttggaacggatgatggcatctgttactttctgaacgccctcatcctgaccaatcacacgtttgtgaagttcctcttccagacccagaatcttggtcttttccccttctgtcagcttggcaacagggattcctgtccagcgggagatgatccttgcaatctcctcgtctgtaacgctctcatgtaccagggataaatcctggctcttcactttttcttcctcaacttccaactgcttctgcagctttggaagttcgccgtactgcagccttgccgcttcattcaggtcataatttctctggacaacctgaatctgtttgttcatatcttcaatctgttcccgcagtttggaaagcttctccacagaggctttttcattgtcccactgggctttcctgccgttgaattcatcgcgcagctccgccatatctttctgcagatccaccagccggtcctggctgagcctgtcgttctctttcttcaaggcagcctcctcaatttccatctgcatgatccttctgcgaaggtcatccagctctgaaggcagggagttcatctctgtcttgatcatggcacatgcctcatccaccaggtcaatagctttatctggaaggaaacggtccgtaatatagcggtttgacaaggttgccgccgctaccagagcgccgtcagtgatcttgacgccatggaagacttcgtaccgctctttcaggccccttaagatggaaatcgtatcttcaacggtaggctcatccaccatgaccggctggaaccttctctccagagccgcgtctttttcaatatactgacggtactcatccagagtagtcgctccgatacagtggagttctcctctggccagcatcggtttcagcatattgcccgcatccatggcaccctctgtcttgccggcacctacgatcagatgaagctcatcaatgaacagtatgatctgtccctcactttttctgacttcctcaagcacagcctttaaacgctcctcaaattctcctctgtacttggcgcctgctaccagggcacccatatccagtgcgaaaatctttttatcttttaacccttccggcacatcgccctgaacgattcgctgtgcaagtccctctacagcggctgtcttgccaacgcccggctcaccgatcagcacaggattattttttgtctttctggacagaatacgaatgacattacggatttccgcgtccctgccgatgaccgggtccagtttctgctccctggccttttccaccagatcctgtccatacttgttcagcgtatcataagtggcctccgggttgtcggtcgtcacgcgctggttgccccgcaccgtgctcagagcctgaaggaaacgctcttttgtaattccgtattcctgccagattttcttcatagacgggctgggattgttgatcagtgccaaaaacagatgctccacagagacgtattcatctcccatggcctttgcctcatcctcagcgcttaccagggctttattcagatactgcccgatatatggctggccgccggatactttggttctggcattcagtgccttctccacattgttcagaaagtgttctttctggatttccattttttcaatcagtttcaggatcaagctgtcctcctgatgtaaaagattatatagtaaatgctcctgttcgacctcttggttgccgaactcgtaagctgtcttttccaagtcctgaactgcctgaagtgatttctgtgtaaatttgctgatgttcataaaatccctccatttcgagatttgtgctctttgttatttgttctagtgctactataacactaattattagcagtgtcaagaggtgagtgctaatttattttgttaaaatttggtgaagtctggaaaacgttggttttacacagttttcagaccattcaccttctaattttttttattctttagttcaaaatagaggtttgacaccaatttgacaccaattctgcaaagtatttatctggttttatcctactttaacagcgttcatcttggaaatttctatctcaatacgagcatactctgtgaataaataccttacatacatcgtcactcatgggaatggtgcggatacctgcctcagtctttagtgaggaattgtggacctgacatccattattccagcacgcagtccacttccgagtataatgatcagtatgggatagtaaaccttgtaggtgttgcttttttcagtcatatatttacctctttgtagactaacaataaacctaaaaagagccttttatagacatactcgggtctgtgtattcagctttcgattagtgctgctttgcaaaatcaccttgcagaagaaggtatcctctgttattattagtttgcgagaataataatgtccagagttcttctttgggcaagggaatcatccagagtaacatctggctttttctatataatgagataatcccttacacacctagttattcaatttttttattccaagagattcatacaacggattcaattgattcttaactgcatctgcaatcttatcaatatccaacttttctatcatcccattgctcttaatccctttataataaaccttattagactgcttatacagtctctgtaacttatcatatccattctttccagagacttttgtattttttcccaatcttaaaaatcccaatattccttcaaggtcatataagaaccaatcttcaatcgatctttttgcctgtacatggattatctttgatgcgccggctttcttcaaatcttgttttatctcattccactttactggtggttttgatgcaaactcaaatacatccgtatcgctacataagacaatcgtataagagcagtcagcaccatacttaggaacaatctctttggtaaattttctaagagcaatactcttaaagcctcctacccctccaacatttcgatattctatattagtatcaaatcggccttgcggatgcatttttctggcatgagcaatcacctgcttgtagaattctacttccgtttcgccttcaacaaacaaaaccaggcatttacccatccagatcacactccaaataatcactaatattactctcggtatccgcaagcatagaaaataagtaatcccctatgctcatgttgaatccagcagcatcattctccaattgtttctggccagtctttttgaaattaaagaactctgccacgccaggtcttctatttacaccaacatgaatccatgctggttccaaatagctgattatatatggtgaatgacttgtaataattactttgcaatcatctagcaactgatcaatgatctggatatacgctctaaacaatccaggatgtactgaattctctggctcttcaattgcgataagtgagatgttgctaacgcttgatacaataatcttagtaagaatcatgaatacacgttttgcaccatcagacatcatagaaaaatttactggattcgccaaatttttatcttttacaaataagacatatatcgaatttgtaaaaataaaaggaacatcttctgggagctgctcattatctccggcattaaacttataattctttacaattacattctcaatattgggaaataattggaagtaaacatcttttaaaagctcaaacttgtctggattctgcttcttcagattaaatataatgcgtggtaagttatcagcattgatcatttcattttcaaatcccttgcgaataattggatctggttgataaaagttctttgcatcgagattattctccatgtaaattttcattccatttatcttctttatgatttctgcataatatagttcatcaaatgctcggagtttattaactgccaactcagaagtctctatattaagttttgaagaacatcttcccgtctctgaacttttatataaagcagaattttttgttctattaataagctgcgtatatttctgccctttttcgtcaagcttaactttaagatattcccgtacaacttcaggagtatcattctcactacaccgccatgaaaactcatatccatactgtacacggtattcatttccatcgtcccctgttaaacactcaacctcaaacctataatttctcccctgcataacccgattgatcggaatcaaattagaattagccatcatatccatcttctcttcgatagatgccttgatgaatgctaatccaaagtcaatgcctgaaagaacattagacttaccaaaattattgagtgcaacaagtgccgttatgttatcaaatataatctttacattcgataaatttttaaagccatctattactactgcctgtatcttcatagtgactctccctttctttaactccgtatccatataataccacctctaaatataatacgcaatatttttttacgttttatttattatatacgtcaaaagtcggtattattcattttatacgcaattataattccctttacagtatagtaagtgaactttaaaggctattttaaaaatcaaatgctctaacaaccttacaaaacaagaggtattcatctataaaattttacagacaaatacctcatccgttatatatcctatattccataaaccagctcattcaaatcagcaagagcggccttacacttttctttctatgtcagccctttagaatagttagactgtagacagtaatattttactcactccgtctcatttgacagcctgacacgttctgcttcttctcggagcatatgcaggaagaatgcctccgggtcactgatatccatgttttccatttgttgtgctttctgctgcagatagataagttctgtcaaatcacaaagtttcgctttgccatataatccttctttattacgtctggggaactgcccataatataaaccctgaataacacaattagattttagcattggcagcaaaatcgtcataaatgtcataagaaccgatgtaggctttaatccatatgtaatacacatatagatatgggaatcattcgacacctcatttagcagtctcatcattaattcaaactgtacctttttactgatctcctcccgaatcaatactttttttacaaccttctcattgatcccgatttcgaaaagctcttgaagaaaacgctcataattacgattgacatcttcattctctatggtaacagctatgattttcatcctccccatctcatccatatgctcttttatgaccggaataataggaaaactggtttctatattctcctgtaattcaaacccttccggatgatatagtaccttatgcagctcaccggctccctgcatggaaattgtagtaatatatgtattttccatctgcaatcatctcctatgccctttcacatatttatggttttatcatagaaatatccctttcccggcctaaacttctactttaccccaatcttctttagccttgttactgcctcttttaaaagctcttccacttctgctttattcatgggttcgtttgaatgtccgtttttattgcttgcatgattgattccatttctttcagctttgatgcttcgatataatcttaaaattccctttaattcctttcgctcacaattagaatatatgggatttaaggggtttttacttataagttcttccagtttatgggtttctttcccattgtaggataaataccgtgcgcggtcggcctcctgtttccaatactccttaaccccatccctatcatcattcagataatgagttaaaaatatgtagctccagtctttccctttcaccagtcttttctcttgtttctttccattcttatcaaagcaaaatttatagcgtttctcaatatcattcctaatatcagggtctatcacaacaggagtttcatccttatccttttctcccacaagcattgatggcattttactttcaaataaggtaagagcctgctgcagaaaatcttttcttatacaccattgtattaattccagaacagtagcacaattctttttaaaaactatatctttcagctccctcggctccctgcagtctaaaatcaatgccccataatcttttaaaatttccttcaggacaaaattccaaaaagcataattttcatcagtgactttattagagttgatatatttatatgataattttttcaactgctctaattctttctgaatctttgcaggatggcacaattgtatatgttcagccagactgttaataacttcaagaatcccctggtcatggcatatctcagactgtaaaaagaattggttcagtcgctttgcccttccatatcctgtatactcatcaatcccagaaatcagatcaaatatcttataggcttttgttttgttaacaattatttttttgtcaggcccaaaataaacgccccaaatgctatgaacataaaaatccctcagttttaaaagctgtatagtgccaagcagaacagtcataaaatcacgaaggcctccattggagtcaatataaaggtgtacatctccttcttcgttttgtaatttctgctttaaatcatacaattgctctgttatctgaatagagcttcgcattaatgccatattatccggtgcatcctttatagaaaattctattatatgttctctattccagacgtctgtcaaattgttaaccacacaatatttttcaatctgttccagataaaattctttatgtgttcttttctttccatcagaaaatgtcgcagatatttctttttcaacagcctctgatacgatcagatatatacagtctaatttctctgcctttttatttatttgggataaaagcaattttgttaccgcttcatttgtctgtatccctttacattcaaaatactgttcttcatccttatatcgatacgtatattcttcattaatcttcttaggatctacaacacttaaatttaccagcagaatatttttgttcatctattgtcctccaaattttccttaaatatgtctaatctgactgctgtctcatcataaataaaccataaatcccctaaataaacactctctgtcattgcattaaaattcttatttattttcatcctctccgtttccaacaataattccttttaaagcatctgccataatatttatcccatatctttagacttttctcttccagattgcttcttactgccggaatattttgttttatcatgttttctattattgtttttatttctatcagtgtactgctttgcattccctccataatgcccgtcaccttgttcctcatatatgatcggatttccctttatcacatcatccacagagggcagttgtatcttttttgcattacgttcttgatattcatttttatttcgctgaatagacatatatctggttctgccgcttggtggtatcttttcaggatccttcatatccaaaaagtcacaaatctgcggtgcaagcataatatcgctgccaacaaagcgtgtcatatcatcctttgccatctgtatatactttttatacttttccgtctctttctccggtttatatggctgcaggcacaaactttcaccattatataaggcctcattatctaaaatctgaagctcctttaattctactgaaatccgtccataaccatatggctttccttttccaatattctgctggctgttctcttcaagaagaagtccccacagtaacataccaagctcttcttctgtaacattattaaatttaatttttccacaaaatttcacccctgcatacagcggattgaaatgtgatgccaccttcggatttttccctacctcccctcttacgatattttctttcaaccagtattgtttgataccccgaagccggaaatcatcattataagaaacttctttctccccatgggatgcttcaagataatccaaataactggttggcttcggtcctcccagtatcatggactgcttgtccgtctccttatagtccgttacaatccgggcatccataaaggatagccttgatttatagcctcctgcttctttggaaaatccaaataatgagttactgtaatccagacatccactcctttggtcccctttcaaaccatctgaaattttatgttcatagaaaaccctgagcctgggggtaaatccaaaatataattttccgcccagctgaatataaaatacaggcttttttctgccgttttccggaagattaaagaatgtcttactgacggcctccacctgattttttctgctttcataatcacgtctgaaattatcaatatcttcttccgggattgaaattgagtctttattttcatctatttccggaataagatagagggcctttttctcctgcatatagccggttgacattaggtatccctgcttcttgtacgttcccaatctatcaatggcgcacaccttatccttctcatccacctgatatgatactgctttataataaggcctatactcatcgttttttcttcctacataatgcatacgtccttttttgtctattttcggttcaaattctccgtcttggttctgaagttccagtgtcttcaaaaattcaaagcccttatacccgctctcaataatttttcgttcactcagcacataataattcctttcccctaactccttcctgatacgatccggggaagttttcataattatatattgatgctttcccacatttttgatatatccggctttaacatttttcaagacagacatctgtatttttttccctcccggaagagcgatttctgtctgatcatatccaagaacatcattataagtctctttatttaatccgctggctacgtgccggtacatcaggtatccatcctgaatatcatcttttacggaggagcagctcaaaatctgtacatttgaacgtaccagtcccctcaccgtgctccccggaattgcatactgaccataacagtctttataaaattcattatctccgttgtcaataaaaattggagtttttgcagtgatttcatatgtgatagttccggattttctttccttttcaatcacattgttaggctgcaatttctccttcttatagaccctgtcactaagtcctacaaaattgtatggagcccctacatagcctttatattttttctgatccatggtttcctccctcatttcatggaaagtggtctggtatatttcaccactgcttggccgtcttcatccggctgcagatattcttttaccaccagtttctttccgttcctcataagataagattttaaaataatgtcctttacctcgtctgtttcaaagacatggactgccttcgtctcaccgttcctctcaaagatatgcaattcttctttctctttgaatgcccgcatttccaaaagttcttcccagttgacgataatactgtctatctctccatattgcatttggctgatcatgtggacaatagcaaaatcataatttccaagagatacttttgcctcttccatcgtcagattttcaacctcaagattttcaattatctgtgccatttctaatccccctgtctgcgaaaccaatatattcttctataacagcggcaccctttacaattttaccggcttttagatcaatttctacaataacctctgcgcctttactgatcttcaaactgtcacaggaaagatagccacgtccaatgctgcttccgcttcccaccggaagaattcccatccccaggtcgcgcagcgccataagaagaagcgcatttccggcgtagtcacatgcattttccatatccacacggatcatcagggagccataagccggcttttcactaaaaagagcctgtgagatcacaccgccggtaaacttatcaatatgtatccgggtctgcttctttactttgtcattatcagccgtatttcccacaacgcaatcgaaaaattttatttcaccaatctttccttcactatgcttctctgcgcaagttccaaaaatattgtcaatgatctttaaattcatacctttataaactgcaattttttccatctggctgcggatggtcccctttagggaagaagccggaatgatatactctttcctgtgatttacaatattctgtgcatccggagactcctcactgtagttagctacactgaccattttcacaaggattgcgccttctgtgcttcccgacaactcaaaatgaagacgttggtcctgcttttctgccttttcaataattacatccgtaatatccttcattcctttttcttctttcggccactgctttctgtcattttcatctgtcagaatataaaccgacttttttactgatacaagcttcacataaccacaaccattacttttctgcccgccaagctggatattcccacaatgtaatgcttctaaagccccttcaaacggcgtttcgtatgatttttctttttcaaatacatatacaaaaaactcaaactcagagcctgctgctactgattcaatctcaaacttctgtccactggaaattgtcgcaccttttacatttatactttgacaggttcccgtctctccatcaatttttacatgtgggcgcagttctgtttctacagcggctttcttaaaaaagccatcgcaaaaacgaatccggctgctgtcactgcctttttcattcaccattccaaacatttcattacgcagatccccatccgtaaagtattcacgaaatgcgcctgcaatccctgttgccggaataaagggacgttcctcaaccggatggatcaggatttccccctgctccttttcacccgtgcctatatggagaggttccctgcactctgcctttacccgatattttattactctgtcatatacgctgccatagcagctttgagaatcctggttattctgcatggtctttctccttcctgttgacgtatctgatctgattaataataagcttcagcttatattttatttcatcatcaccggagagaatatcctttacgcggataccaaaaattttattttctttccactccaaattcaaaatttcacataaatccttctgcaagacttcattcacatagagatgcaatagctgtcgcttttgggtctgatccttcaaacgactgtccttcacttctaaatgtttaatgtagcgttcaagctgttcccgtgcttcctgcggagtatagcgaagctgcatacacatagattccacaacacccctcttactctttgaaattccttttagatttccggtagacgcatcttccacaatatatttttctattgccctttcaatgcgatactgtagaagacctttcgcggcaatctcaagatccgattgaatctctgctcgttgcagagactgttctgttacagtatcctcatatttactactatctgtattttcgtcataaaaagcctttttatatctaatttcaccataagaatcccaaacggcaatctgtccgaacccttcatttcttctgattccaattccttttttttcaagactgcgaagcttttctttctggagcattcctactgcttttatgtaaaaaacacttcctgcctcatacatcaccgctgatggtacagctcctttccagatacgattgtaaccatatacttcccgaatggatgtcgcacaacggataaccgtcagtttttcgcaccccagctctttctccagttccggaatatacaaacctgccatttctccatactcattcaccatcaccatatcggaaagaagaacaaggaaaaatgtatcggatatctgtttatttcgtaacttttcgtaaggcatcccttctttaatttcagtgcttatgcatttgcacgctccatatcctgcagagcgcttattacccatataaataatgccatggaacacctgtgcgatcagtaagatcaattcctcttctatatcttccgtaaaattgatataccctgcaaaacgctggcctttttttatgtactgacttcggaatatggctttatcactgtctcttcctgtattaatatttaagtcctccccagtctgcacatctgtataaaaaacacagtcctcattaatataacaataatgccccagagatgcccttttcgtacccggggcaatatctcctgtcattacattctctatagtttttttccccggatattcctttttatcctcatagaagcctttcagagatggaatcagttcctttttttccaccataaggtatgcattcataaactgtaccttgcttgagaaaatctgttttttatatttctcaaacttatctccctgcgaaagcagactgtttacaacaaggccgcgcagcgtactgcccggaatatatttcagtgtatccgtctgtccatgctgacttgtctcatcatttgcgattctgacaggggcaacgttttctatcacaaatcttatatatctactcatctgctttccccaccttcatctcaatttttccaaagcctcggtttctcatacttcctgcccacttaatcatggtcaatacgctgcatactaaggcttcatcctcttcagcgcagcagcatgttccataaaaatttaatccctttttaatacatctcgccattcggagggagccgtcctttgccaaaccatcttccaaacttgtaaaagtccgaagataagtaaaaatattctgaacctcctgccgggaaattccttccgccaatattgattcctgaagggccgggtgaaaaatacaatctgaaaaaatcaatttccgaggattattaatgtcatcatttccgcgttctccagccaagcactgtaccgtttctctgatctcctccggggatttctgctcccaattcagaaaatttatcaactcttttctgaaaagtccttttaatgtgctgcctttcatatagggaaatccattggtatctgtctggataccaatgtcctctcctcctggtatgctgactccatttccaaatattgcatctgattccaaatgcatttgtattattaactgcattaccgtacctcccatatacctttaatcaagatttatatatgtatccagtatttcaatcgcgtcaaaaaatagtgccctgtctataccatccgctgtctgtgcaaaaatttttctatccaatcctttaccggtaaaaagtctgttgctcttcacttcctcatatattcccacaaagccttccaatgccagctcatccatcagattgtttttcatataataccaggcagcctgctctccctcttttaatgccgcacaaaattctttgatctttccgcgggcatatgcaatatcatggctttgaagactttttattaatgttctaaaatttccataacggcggattttttctttatcccagatatccttttctgcccacagcagatacggccgaagttctaattgttttccatctgcagtctgatactgttttctcatctcagccagggaatctaacataaccccaaactctatatgccagtcaatagcacaggcagatgcactcgcatctttctgctcatcggaaaaggaagcaatgtatttttttgcattagaacagaggatttctgatagctcatacgccttataaaatggatattttttatgaacaatagccacacctgcacaggcagtatatcccttctgatcatagtcgttctttttgcattttaactgctcaatgaaaatccttgcggcttccagtccgattcttccctctgtcacaaagcagacatcgtcccctgcaaggataattttgcgtacaggaaacatcttcccctgaagttccaacgcagaaagatttccatttttcaggttttctgccactcggtgaagcatttctttatatgcttccttaaaattcttgtccacagactcactgaatttcctcatattgcttttatattctgcccagggcttcgtctgattttcccttcgtattttttccaccctttttcccatagcatttccatcaatatggactaccgcaataaaactggattcattttttgaatttcccagatcatcaaactgcgttgggatagaatatccttccggtacatcttccgactggggattccacttgattctatcaactgcttctactgtgggaatcgcttttcggagagtggcgtccattctctctaccccgaaagttccctgatgaaaagcggccgcacgcacagacttttttacttccagggcttctgacagacgctttaaattctgtcccgggtcttctgtctcactatattgtattgttttaatgaacaattccatttccggaaattctctccgcacagtttttgatatctcaaaagcaaactccttggcaattttctctgatggaaactccaaaacagtatgtccgcctccggaatataccaggttatcctccatggaaaaatgtaatcctgctctggcggcgacatcctctaaatatctcgaatccgtcacctgaacaatagcttccgaattctcaatgttgtcttttagttttgtactggcaaatatgtacgcctgtttttgtgatacctccagtatcattaaataccgcatagtatttcctcctttaatctgatcatttttttatcatgtcatattccacatatcttttataatccaggagacattatagaattttccatatgcgtagttccacaatctgatattaatacaacccacaaatctatcattttttacaataaacagatatgatttgcgtctatttatagtatattttacactatttaccagtttttcgcacctacaaattacacaattttacacaattgttcctggttcctcttatacttcagttaaatagcctttctaaatttaatatccttctattcatttaattgttctttaatgatgaagctgccatttatccccacaaacttttatggtatcctaagataaagcatcatgccagatacccctcacctcactgaaaggagaattcctatgttttcctacgaagacatccaaaaatacaatgaaaccgacatgcacatctataaatatatactatccaacttagacaagatccaatatatgacaatccgcgagctggcaggggaaacccatgtatcctcggctactctcctccgcttttttaacaagaacaaatttgaaggatactctgattttaaaaatgccttaaaaaccgaaacaaatgtcttaaaaacacacaccccgatggcggactcacaggaactctccttctttttttgcagagtaaactccagtgcctttgaaaaaaagctggaaatagctgtggagctgttaaataccgcagattatgttatcttcgtcggcatgggctcctccggaagcctggccagatacggcgccagatacttttctaacttagggaaattttccgtaagccttgaggacacttattatccggtggagacctttacctgcagctttgctgccgtgatcgtactctctgaaagtggagaaacaaaagaaattatagaattagtccagaaattccgtcaaaaagaatgtctgatattaagcgtcaccaatctgccaggttccaccctggaaaaaatgtcagactggaatttttgctgtaatatgaaatccaagcgaatccacggcggatacaacgcagccacacaggttcctgttctttttgtcatggaagctctggcgcagagactgtaaaagggcagcgtttcagacaaactgaactgttgcacaaaggaaacagcctgttacttgaaacggaacaatatttattctactatagggtcaggaggtgtatcatgaacgaattagaaaaatgtatggcaggccaatactacaactgccacgacaaaatattcctggagtttaaaaagacttccagaaagctgctcgcagaatataatgctctggcctatgaccaaaagcagaagaaaacagagattctaaaacaattattgggcagtatgggtacaaacgtctctgtaggactccctttcctctgtgattacggccgaaatatccatattggaaacaatgtctctgtaaatatgaattgtacttttgtggactgcagcaaaatcgagattggcaacaatgtgctcatcgcatccaatgtccagctctacacagccacccacccggttgaactctccgaaaggctcactcccggctggacagatcagacagattcatatttctgccgtacctatgcccttcccatcaaaataggaaacggctgttggcttggcggcggcgttattgtactgccgggtgttaccattggggatggttccgtcattggcgccggaagcgttgtcaccaaagacatcccacccaactgtgtagctgcggggaacccatgcaaaatgatcagaaagataaatggtgatacagatgattaaactgacagcatttgatctggacggcactctgggaaatacgcttccaatgtgcctgaaggcatttcgcgcctccatcacaccctatttggcacgcgaactgagctatgaggagattgccagtacatttggcttaaacgaagccggaatgatgaaaaaaatcgtgggtgataaatgggaaccggcactgcaagattttcacaaactttataagaaaatccatcacacctgcccggccccctatgatggaatcccagcacttattcaatatctaaaggccaatggtgtcacagtctcactcatcactgggaaaggctctgaaagctgctctatcacattaaaccaatggggactggacaatgtattctcagacattctcaccggcggcgagacaagaaacactaaggcggaatccatgctttttctgctcagaaaatacggtttatccccctctgatctggtatacataggcgatacagcatcagacatcaaagaatgtcataaagccggtgtcacatgcctgtctgccttatggggggacagcgccgaaaaagagatgatatcacaggaaaatccggaccatgtattttacagcatagctgatctaaaagagtatataacctctcacatttccctttaaaagccgaaaaaaaccaggcatggatacactcccatgcctggttttctcacaattattatttcatcacttcctgataagtcgcatgtttttccagagcttctgtcatctctgccagacggcttacatcaccgatcaagatgacaccacagagcctgttattcaggaaatagaatttctgatactgttttttccccatatccttaaactctacggtcttatagatcagattgggatttttcccattatctcctgccgcgaagagcgcggtccccattccatggaagttaagagctgctgatactgtctcatattccagatcatcccctgcagcattagctcctgcagtcttaccctgttccacagcctggctccatagtccgtaattgataccctgatactgggcacagtcaccacacgcataaatgtcttccacattcgtttccattttcgcattgacaacaacagagcggtccacttcaatccctgcatcctttgccaccgcggtgttggcccttattccgcaggaaaccactaccatatcagccggaagaacttccccatcttccatacggattccagagacaaaatcatccccttcaatagctgcgatcttaacgccggtacggatttcgatatcctggttctcacttatcttcttcagaagctcggctgcaggctcatccaactggcgtcccattataacaggcgcaagctccagcacagtcacatggcatttcgctttcttcagctcccacgcagcttccagccccagcacaccaccgccgatgactatcacattcttcacctgaggaagcacatctgctatctttttggtgtcatccagcctgcggacagcaaatacattcttcttatccgcacccttgataggcggcacaaagcattccgatcccagagcgtagataagcttagtatatttcaatttcataccgtcatccagaacgacttctttgctgtctgtatcgattctatccacccggcggcccaggatctggaatactctgttctcctcataccatgaagtctcatgcacagcaatctgatcagcattcaaatccgccataatagattttgtcagcattggcctattataggtactgtatatttcattggaaatcatggtgatagaccctgtcttatccctctgcctgatagcttccgccgcgctgatccccgcagcaccatttcccagaatgagatagaaatcctttgtatcccggctaaacgtattttcttcctcttccaccggaacaaaatgttctctgccaactccgcagaccggacaaatatcaatagaggaatcaaaaatagcaccgcataccaggcacttcaccagcctgcttctgcctgactttctctcattttccttgtcctggagcgtacatccaaaattataaccaaagtcataggcatcgatcaaatctgcctcactcggtttaaaacgcacgcgaaaaccgtcaatggtcctcatccgaagctgttccagccgctccatcacatgaggcacgccttcaccgctccatccataactgccgaatgcgcttgccagctttttcccatgtgtcacaggatacatagagatcaacaaatcccaaataggcttcaaagcctcccccaaaatagtgggagtaccaaaaaggataccatccgcaaatcccagttcctccagcaccttctcctgctcagcatccaccaggtcatagctgcgcacagcaatatccccgctgtcctccacgcccttggcaatcctctctgccagcatctttgtatatccataagcgcttacataagggatgatcacggttttcgtgctgttaggattcacaactgtgcaccattcctcataaatatcatacatctgttcaagcttatcatccagcaccggtccatgtccggtacagatcatggacacatccagcttccgtaccctttccagcgctttcagcatataaggtttaaacggtcccaaaatacagtcaaaataatattttgttgcccgcatatacccttctctatccgttaccttacttgacagtacatcttcaaatccataatgagacccaaaagaatcacaggtaaccagaatctgttcttcctcaatataggtatacatagtatccggccaatgcagattaggcaccacaaggaactgcagcgtcttgtccccaatcttcatagtctcattatccttcaccgcaataccggtaaaatcaccatttacaatctccttcagaaacccaagggcacaacccgttgccacaattttaagcccagggttcagcttcagcagattctcaatacttcccgcatggtccggctccgtatgactcacaaccagataatcaatcttatcaaccgctgtgatctcctgcaccttctccaaatactcatcccagaacttcaccttagcggtctcaaacaaaaccgtcttatctcctgctttcagcacataagagttatatgtagtgccgaactccgtatacataataatatcaaacacccgcaagtccgcatccacaatacctgtccaataaaaattctttctaagctccaatgttttcaactcctataccttctttctctctttattatcagtcttaccccacaaccccattatattccaaaactcccaaaaaagaaattcttatttacctatatccctcataatcaaaatatataccattttgctccacattaaaacccccagttttgaatttttattatcaacctctatattttatcttttttcttttatatttttatcttttatgtttttatcttttctctctcagtcttccgctctaatcccccgtccccccatcccaccaaaaaaggacccatgctcccaaaagcatgagtcccaaactatgtacgaaaatcaattaacaatacgtctaactgcaatataaggtctatacaacgcattgctggaatatttaattccaccctgcggatacggtgcagagttggatgcatgtacaataccgccgtcgcctgtcaggattgcaacatgtcctgaataaacgatgatatcgcctgcgcgtgactgagaataagaaataccgcgtccgtctccagcctgtgaatcactggttctggaaatgctataaccaaagtgagcgaatacctgctgtgtaaatcctgaacagtcaataccattagtcagactgttaccgccatacacataaggattgccgataaactggctcgcatatgcaacaactgcatctccagtggcactgcttccgccgccctgttcctcttcaggctcttcataggatggagtctccggttccggcacataattgttaccgccgccgccattgttgcttggagtctctatctcttcttcatcgtcattgttgttgttattatttgtattaccgttattgttggtatttgtattgctctctgtattagctgaattctgctgtgtctgtctctgtgcagccgcctccgcttcttttgcagctttttctttggcttttttagcttcagcagcctgtctagcttcttcttcctggattctctgaagctctgcattctgctcttcgatcaggcttctgtactcatctgcctgtgcctgaacatttgcaatctgagtctcataatcggaagcaacggcttttttctcttccagtgctgcctctaagttcacctgctggtcttcctgagcctgtttcatctcttccagctcagccttttcctgctccagttgattccccaggtcagttacctgctgaacggtatctctcagtttctccagctcgtccctgtcaaactgatacattttctccgtgtattcggccttgctgagcaaatctgtaatactgttgacctccagaagcatctgcgcccatgcatcacttccgccgttctcatacagatactggattctttttttcattgcagcatactgctcatcgcggtcagcttctgcttctgctaaattctcttttgtttctgtgatggcgccctctttatcagagatttcacctttcagtatgtcaatctgtgcgattacctgaaccaaattctgatccagagaatcaatctctccaagtaaactattctttttctcttccaactccgcttccttgctctctgttgcggacagtttgctctgtgtgtttgctttttcagcctgcacttcgtcttttcttgcagctgctaccggcattacctgtgctgcggccagtgcaaaaataaggctgagacaaaggaatctctttttcatactgctatgtacctcactgttggtatttaatatttgctactctctaagtaatatttccgaaataattttcacttcccgcttatgatatcacaaatttattacacttgcaagaggaaatccctgaaatctttaagtttttgttacaaaaataaattttatagtaatattttataaaatcagcccatataattatgcctttataaggcacatggacagtctgcacagattccccgtttttcaattttttcataatatacaaaggccgtgccctccacctttggtgacgaggcacggccctgttaagtataataatgtattactactctatgtaattactctacaatccttctgactgcaatatatggtctgtacagagcattgctggaatacttgattccgccctgcggatatggtgcggagttggacgcatgtacgattccgccgtcacctgtcaggattgcaacatgtccggaatatacaatgatgtcacctgcacgggattcggaataagaaatcccacggcctgcgcctgcctgatcatcactaacacgcggaaggctgtagccaaagtgcgcgaatactgactgtacaaatccggaacagtcagcaccgtttgtcaggcttgttcctccccatacgtatgggttgccgataaactgactggcataatctacgactgcctgacctgttgcgctgtaaccgccattgctgctctggtcttcttcaggctcgttatattccggtgtctcaggctgattataatccggtgtttccggttcttctgccggaggtgtcacattattattgtcttccgtatcccctgcattgttgttattatctgagacatcatcattggtatcattatctgtattattgttggagctgccattatttacacttacatctgtactgttctggctgctgttttcttcctctgcatcttcctgtgcctgctgctgtgctgcttcctgagctgccttttcctgagcctttctggcttcctcggcttttttagcctcctctgcctgacgggctttctcttcctggatcttctgcagctctgcattctgctgctcgatcaggcttctgtattcatctgcctgagcacgcacatttgcaatctgcgtttcataatcggatgctgtggctttcttctcatcaagagcactctgcagacttgcctgctgctgctcctgagcctgtttcatctcttccagttcagctttctcctgagccagctgattgccaaggtctgtcacttcctggacagtctccttcatcttcttcagctcatctctgtcataatcatacatcttctctgtgtactctgctttgctgagaagtccggtaatactgtcagattccaaaagcatctgtgcccatgcgttggttccgccgttctcatacagatattggattcttttcttcatatcctcatactgcttgtcacggtttgcctctgctacggccaaatcatcttttgtcttgtcgatcgcactctctttatctgtaatctcaccattcagaatatctatctgtgccataacctgcacaagattctggtcaatggagtcgatttcgttcaataacgcggttttctggtcttccaactcagattctttgctctctgctgctgataatttactctgtgtctctgccttctcagcctgcacgtcatcttcccttgcagctgctaccggcacaacctgggtcatggccattgtaaaaataagactgagaataagaaatctttttttcattattatgtacctcactaatcatgtctgaaattgtaactacttgtaacatttttgaaatatttcttatctgtcacccataataccacataattattacagatgcaagaggtaaatttccaaatcattaaatttttgttacaaaatggaactttttcgtaataaatagcgagatatacttttaacaactagtacatcgtaaattaaataactgcactatcactgagaataatttttcgagagtgcaggcgcaaaaacgtaggcgtagcgggctacgctgaggcttttgcacctgtgctatcggaaaattaggccagcgaatagggtagttatttaatgaacgatgtactaggcctcaaccacaacagtattgctgtcttctttctcttggggcagtacctttttaggtgtggataccacctcctgattgtaacataagaaaatatcttccactttatctttctccattttaggagtgaccagactcaccacgggcactacaacaaatcccactaccattgcgaaagcccctgcattaataggggacgcaatataatgtaagaacaggttggataccgtaatcccgatccccgttaaaaagcatacccatacagacagtttggttgttcttttccaatataatccaaataaaaacggtgccaggaaggctcctgccaatgctccccatgaaatccccataagctgggcaataaaggtaggcgggtccagagcaagcacaactgaaatagctataaacaccacgatcaatccgcgcataacacgaagctgattcttctcactcatatcctttgccacagtccctttcaggaaatccagagtcagcgtagaactggatgtcagaaccagggaagaaagcgttgacattgacgcggaaagaaccagtacgataacaataccgatcaatatatccggcagtgtggacagcatatacggaatcactccgtcataaatcactgtaccgtctgctttgtataaggaaggattatcaaaaaggcgtccgaatccacccagaaaatagcatccgccggagataacaatggcaaacactgtggagaccacagtaccggtctggatcgctttctcatccttgatcgcataaaatttctgaaccatctgcgggaggccccaggtacccagagatgtcaggataactacgcccagaaggtttatagggtctggtccaaaaaaggaggtaaaggcaccagactgcccggcagttaccggtacatcacttggaatactggcaagctgtctcacagcctccgtaaatcctccctgtccgcttaatacggccccgataacagcagcaataccgaacagcataatgattccctgtataaaatcattgatagccgttgccatataaccgccaaggatcacatatgcaccagtcagagcagccataaccactacacatactacgtaaggcacatcaaaagccagctcgaataatctggacaacccattataaatagatgcagtgtaaggaaccaggaaaataaatacaatggctgaggcagcaatccttagggcattactgtcaaaacgcttgccaaagaaatccggcatagtagctgcatgcagatgctttgtcataacacgtgtccttcttccaagaaccacccatgccaaaaggcttccgattatggcatttcctatcccgatccaggtacctgccaatccgtacttccatccaaactgtcctgcatagcctacaaacacgactgcggaaaaataagaggttccatatgcaaatgcagtaagccagggacccacactccttcctcccagcacaaacccagccacatttgtagcatgttttcgggaatacaggccaatacccaccatagagccgaaaaacaacagcaaaaacagtatcttaatctccatctttttattctcctttaatatattttcgctcacgctttaaaccgcaacggtttaaaccattaaagcaataattgcaaagaaaaagaggcgccgctctccgcttggaaaagcggacgcttcttgttttcttttatccaggtatctgttaagtaccttcacagttacaagcaaatatcttcctatccgcatcttatttcttcagatcattcagttcttcctctgtgaacatcttcatacctgcatcttttagtgtctgatatgtacgtgcctggtcggatgttttcaccaccatagcgccgccctctttaccggtgaccagtgcatacatatattccagattcagccctttagcgcttagagtatccatgatccggctcagtgcccccacttcctgctgcagttccactacaagcaccggagtcagcactgctgtgtaccccttttccaggagtacctgtttcgccctggctgaatcagacacgatcatcctggcgattccatagtccgtagtatcggaaagccccagcgagataatattaatctggttctccttgagtgcgtcagcaactcccttcagtttacccggacggttctccagaaatatggacaattgttcaataaacatttacgctaccaatcctttctctgtcttctatatctataaaaacagggaattttctgctattttaattcatatcctgtcaggaatgcttttttatttatctccacagtcttagggggaacggtcttttcaattacattgagccactcttccctggagtaatccatatgctgtgcagcaactcccagtacaataacattaaatacttttgtattgcccagttcttttgccaccttcatagcatccactgcataaaccttgtgtgtctggcggagagtatccaggataccttccgggtactccgctactcctgtcacaactgtgatagggtcaatcctctggtcatttacaatgatcacaccgtcttttttaaggaactgacggtaacgcagcgcttccaggcgttcaaatgcaatgagcacatctgcctgaccttcctccacgatcggctcctctactttttctccgtaacggacaaaagtaactacacttccgcctctctgtgccattccatgcacctcagagagttttacatcgtacccgccttccacggcgagtcctcctaaaatacggctggtgagaagtgttccctgaccgccgacacctactatcataatatttcttgttgccattacacttctacctcctctattgcatcagcgggacagagttgtttgcagagtccgcagccattgcacatggtatcatcaatggaaatcgttccatcttcattcttggtaagagccggacatcccggtcttaaacaaagcccgcattttttacatttctctgaaaccggtctgcactttgtcttaaatacattagtctttaaaagtacacaaggtgcctgggcaatgatcacagagacagcgtctcttgccacttcctctttgatggtcttttccagagccttaatgtcaaacgcgtttaccacattgacatgttcaataccaatagccttacagagtttgtagatatctatggcaggaaccacctggcctttcagggtcttgccggttgcggcatggtcctgatgaccggtcatacctgttgtggagttatccaggataatgactgtccctgtcgcctggttgtaaaccatgttcataagggaattcacacctgtatgcataaaagtggaatcaccgataacagccacccagtctttcacatattcttttcctctggccttctccattccatgcagagaactgatagacgcccccatacagatcgtggtgtccacaacactcagtggagcaacggctcccagagtataacatccaatatcgcctgccgcgtggattttcaattttttcagtacagaatatacgcttctgtgaggacatccaggacagaggataggcggacgggccggtacctgtgccggtgctgctgcctcgatctcctctcctaatacttttttgcggatcatgttggcactgtattctccctgcagggtaaatacatcttttcctgaacatgcaatgccccaggatttgatctgctcctcaaaaacaggttccagttcctcaaatatgtaaagcgtatcaaccttagacgcaaactcctctatgagctttctcggcagcggatgtaccatacctaatttcagtacacttgcgtttggcatagcttccttcacataattgtatggaataccgctggtaataaagccaatagaagtatcatgatactctgccttgttgatctccaggctgttggcatcctctgccagctttttcattctctcttccactaccggatggcgcttgatggcattgcccggcatcataacgtatttctggaacttacgctcataaggagtgtcttctctctccactctgtcttccagctctacaattccctgggaatgtgccagacgtgtggtggttctcacaaatacgggggtatcatatttttcactgaggtcataagcagcctttacaaagtctttggcctcctgggaatctgacggctccaataccggaacctgcgcagcccttgccactgccctggtatcctgctcattctgggagctgtacattccgggatcatctgccactaccagaaccagtcctccggttacaccggtgtaagctgctgtatagagtggatctgctgccacattcagtcctacgtgcttcatggatgccatggcccgtacaccgctgatggatgcaccaattgccacctctgttgccactttctcatttggcgcccactctgcatagatttctttatattttactatgttctcactgatttctgtactgggtgttccgggatatgctgcggaaacctttacccctgcctcccaggcacctctcgcaatggcttcattgccaagcatgattttcttttcgcccacgtttcctaccttctttctgagattgtgtttcttctataataatatatattctattgtaaaactaattctttcttaaatcaatcacacgtttcgcttttccctcaaaacgctggatagaattgggtgataccagagaaacttttatatcaagtcccagaacaatacggatcttagacttgatcttcttttccagttcctgtagagctgcataggaatccatcatataatcagaaaggacttccactcgtatttccagagtatcactgtggttctttctgtccaccacgatttcataatggggtccgcactcttcaatattaaggagcacttcctcaatctggcttgggaatacatttactcctctgatcttcagcatatcatctgttcttcccagcaagttttccattctcactgtggttcttccgcacttgcagggttcatacataagtctcgtgatgtctttggtgcggtaacgtataagcggcagcgcctcctttgaaatacaggtgatgaccagttcccccttctctcccggcggaaggacttctcctgttctgggatcaatgatctcaggtataaaatggtcctcattgatatgcataccgttcagctccagacattccccggagactcccggccccatcagttcactcataccgtaattttgcgtgatattcatatgatcgccccaggctttgtacatctcctgccgcatagcttcggtcatcagctcgcttcctaccagcgcggtcctcatctccagatcacgctgtggatgaatccccatctgctccgcaacctccgcaatacgcagcgcataggaaggtgtagcgatcagcagtgtggttccgaaatccttcataaacatgagctgcttctctgtattgccggtggaggaaggaacaatggccgcccccagtctttccaaaccataatgaagtcccagcgctccggtaaacataccgtatccgaaacaaatctgcgcaatctcgtcaggctgtgccccgcccatacatgcaatacggcagacacactctgaccaaacatccaaatcttttctggtatatccaacaaccgtcggcttacctgtagtaccgctggacgcgtgaatacggatcaaatctttctttggtactgcgaacagcccaaagggataattatccctcatgtcctgctttgtggtaaacggcaggttatgtaagtcttccagacctcttatattttccggcttaatgcctgcctcatccatctttttccggtaaggctccactgtattgtagacacgctccaccgtctcttggagacgcgtggtctgaatctctttgatttcctcccgggacagtgtctcttcttttgcccaaatcataactctcttcccttcatttctcagccctcatccatttcagggaaacctgctgcctccccgcagagctgtctgtgcttcctatcttatcatatttatcacgtcaaagcaatgaagtatccggattttcttaggaatatttcgttattttttgcagattttctttgctcctcctgcattttatgttaaaatgtgaaaaacgagaatgtgttgatcacaaattttaaaacaatagttatagaagaaacggagataagtatgaagaaaaaattaaatgaattgatttacgcaatttcccggtatactgagattgctctgtcggcaatcatgctgatggttatcattgtcctgatcatacctatgatctataacttcatcagtatccccctgctcagtatcaaagccagtcagttcaacgaatttctgggcaatatcctgacactgatcattggtgtggagttcgtaaagatgctggcaaaacatacagcggaaaacctactggaggtgctcatgtttgccattgccagacagatgatcgtggaacaccttgatatgatcgataccctgatcggaattatatccatagctattatatttgctgtccgtaaatatctgctgctcaaatcaacagatgacaaggaaaaaatttacgataagttgtaaaactacagccgcttagcccctgtgctctgcggctgatttcatgccttttcttctattcgtactaacacttcccagtatcctttgtgactgctgcccacatggcggagacctcccttgtctttccacttcttcatataatacttcacccggtctacattccagtgcagttctctagccagttccctctgggagataaatggattgttctcaactgcccgcaatagctgtttatcatagacagacatattcagtggcgcagtttgggtagtatttctttcctcttgggtgggattctgcattgtttgggtaggaatccataccgtttgggtagtgtttttaaaagtttgggtagtatgttcagccgctcgatccataaattcccttttttcgttctgtctttttgttccatataccggaagtctttccattataaaagaagcatttaatagatctgctgattcccgatacagatttacacggaaatccattcccgattccaaaaattcaggttcgcccactccgaactccctgcatgccttcaacattttgggcacgccgctgccccactgttcgatgatcttcatatacgtaaatgcattggcaactgctctgtttctcggtcgggaatatccctctctcatctgagcaagggtcaatccgccaaacaacatacccggagatgtaacctccaaacggtcatcatatatggcaacctgcacgcatccgggattcagataactcctgtgtgtcactgcattggcaatgatctcacggatacagatgatcggcagttcatagtcatccactctgtatagccctgaatatcttgccccataacgtatattgcgcaggacaaaattataagcatcatcaatttgtttataaataggccctgtgtaatcacgccgttccaggaactcacccctcgttgtgcctttgaacacggcacattgtatcttcgcctgcaaaaaatcattgtctgtcagcagcacaaaagcattggtaggtaatattttcccttccttttccgtcaatatcccccaggacagcagattacttttagtcactgtcttcactgctgctctttcattctccgtactgcacatcttcagcgcgtactctctcatagaactgcacagcgcctcaatctgcgtatctcccaccaggcggggagctgcataagtctgatcaaaacaccggttcatcccctcaaactccaactcccgcagaagatagctgtccgccggccgtgaagttcctgcaatcctgacatatgtcccggcttctttccccaatgatgtaatataatatggccgctgtccgccaggatagatctgcaccacgatcaatgtcttatcttctactgtctgcaaggtaatatcaggaatgatcatgggcgtacaactatcacaaatagcgttggtaatactgtccatgtcctgaaaaacagtttcgggcggcacccctaaaatttggtgcgttccgtcctcaataccaaaaatcagcctgccgcccgccgtgttagcaaaggcaacaactgtcttcatataccgctcacttctggccggaacctcctgtttaaattccaaattttttgattcaccggaataaatttcttcgattgtcatattccaccctcccgtatatcaggaacaggtaactgttccataccttcacagtcacagactaaaactcatgcgaaaccgcctttagcactgaaaacctacctgctgcagtgccttttccacaaggggctgtcctatcgtcagcccggtatacacgcagatttgccgaatcattatataaacagtatcagaattactgctgctttacaagatactgacaacaatttaaagaatgcctgttttgttataagaattattctttcatagacatagtttatcacactttgcaaataccctcaatgcaaatcgaacatacattctgtttttcgtgatataatacaaaatctgccggtttcaaaccgtttaaatttgtctctatttgccatagactcccccccagaagcagctcgaatcccggtaagtaaaaacagccggtacagatcatattctcaatccataccggctgtcaaaaaccatactcatactaaacaatattgttcccctacaaataccttacaccacaataaacggtatcacatacgccgccgcagcaatgacaacagcacatatcaccacagtcctccaaattttaaattctttatccatcttctgtctctcctgaggtgtggggatttcttcctccatgatcaggcggtccacttccttcgtctcatcactctgataacgtttcctgcagaaagcatatatgatcagccccaatacacaccagataacacctgtcaccagcgcttctttgtcaagctgtgtcatcatgacaaggtagatgatcacgctgatgggcgccccgatcatgattcccggagccttaaaaggccgttttaaatcagggtgtttcttacgaagcccgaaagaggctgcaataccgatcacatagtagaacagatctgcgaacagactcacggatgctatgtagatcatggagttggatgcgatcaaaaaagcggaaagcaggccaaggacaatgatggaaatataaggtgtcttatatttcggatgaaccttagcaaataccttcggcatagccccgtcacgtgccatggtaaacagatatctgggcggcacggcaatactggcgttcagtgttgagaaatcaccgccgaatgcaattcccgctgccaaaaggatcaatggaaatccaagaatacccgctgttttcatagcctccgcaaaaggtgcgctggctgtggataatgtggctatctgctctgtgggtacgattcccaccaggaaccactggaatgccgcattgactgcaaacacaataaacggtgcgagaaacagggcacgcggaatgttgatctgcggatatttgatttcctcacccatggcgcagcaggtctcaaatcccgcaaaacaccaccatatcatactgactgatgcaataaaaccaagcggggtagactgggcaataaaatcaggtaacttcacgaagttaggcatattcacattggggatcatggtcaaaaaccagatgacagccacgccccaaaaaaagaacataaatccgttctgaagccttccggtcatctccacaccacggacatttgtaataatgaacactatcaccaccacggtggcaaccacacggtcactcacaggcagatcaatgcccagcgcagagaagaaggtcttgaagtaaaagctgaaggccagtgcctccccgctggtaacggctaccagagaaatgataaagttccaccctgcaagcattcccataggttttcctatgcccagggacgcatactgatatgtacctccggcgtagggaagcgcagaccccatctccgcatacagcagtgccggataaatactgataagcatagccacaaatgtagccagaataaccgcaggtcccaggccgcccaccacattggcgcctgtggtgaacagacccacgccgaccacggtccccactgtgatcgtgactgcttccttcatcccaaaggttcttttcaaagtatttgtattctgatcactcattgttctctctccctctttattctgtcaatttactcctgctttccctctgaaaaacgaatatcagcagcctgcttgtggcctttcagtccctctccatcagccagcctggacaccagaggagcaatatttctcatagcctcaggagtcatactctgctgtgtacatgttttcaaaaaggttcccacccatacgccgcctgtataacgggcagctttcagtgtgggcagcgtatggttggtaccggatgcatagtctccgaacacctccgctgtgttttctcctataaacagagaaccataattacaaagtccgggaatcagagcatcaggatttttcacattcagttccaaatgttccggcgcatattcatttactatgttcactgcctcctcaaggtcagataccacaaccacctctccgtatgtctcccatgattttttcgcaatatctgctgtctccaacagctccagctctttttccactgccgccatcactgccttgccgaatgcctcgtccgtggtgactaccatgccctttgcattgacatcatgttcagactgtgccaataggtccgctgccacgatctccggtgtgccgctgccgtcagcgatcacaagcacctcgctgggaccggccacaaagtcgatgcccacctggccgtaacactgtcgcttggcctctgtcacaaagcggttgcccggccctacgatcatatccaccggcgcgatctcatcggttccgtaagaaaatgcagcaatggcctgtgccccgcccaccgcgtaaatttcatccacgcctgcaatatccatggcagccagtgtcttgggattgatctttcccgtgcctttcattaccggtgaacatgccgtcacacgctccacccctgcagtcctggcgggaatgatcagcatcagtgccgtagaataaagggggtaatttcctcccggcacgtaacagcagcaggattttacaggaatgatcctgtgtcccagaaaaattcccggcatggggctaaagttttcaagaggcttcacagtctctctctgtgccctggcaaatgcctgtatattggatgccgctgcctttaaatctgcgacttcctggggggaaagctgcatataagcctctctgatctcctcctttgaaacacgcagggaggttctttcacactgatcaaattttctgctgtactccctgagcgcttcatctttgtttgctcgtacattatcaatgatctcctgtaccatacgggacaattcttttctgtcctcctcggttctcacctgggctttttttaatattttcatgatccatacctcactttatacaaattccatatttcctctttatcgtgataccataataaatcatagagtccgctttaggtcaatatcctgttttttaaaaaaatgccacaaaccttgagtatactccagatttatgctagtataaatcaaagtaaataactccgtgtttttcccggagtgtatcttagccatgaaacgaatatggatttttcaggaggtacagggctgtgcgcataggaaaagtatcagaaaaataccacatttctgtggataacatctactattatatcaattacgggctgttggttcctcccaaaccaagagggcaatatgtatttgacgaacagactgtcagggatctggagtgggttctgggcttaaaagagctggatttttctctgcgggagatccacgtcatactgtccctgaaacgcatctcaggattggcggacccgcaggatatggaagaactgaaagagatcttcaaggggaaacgtgacttctgccaaaaggagatcgggcgcaaacagcagatactggaacaactggactcacacattaaatccatggaagcccgtgaaagcatcccccagcacagtaccggtgtccctctctcggcactgccccttctgcgctgccctgtctgcggaggttccctctccctgtctgaggtggaaatggaccagcgctttatctacaaagggaacttatcctgtacctgcggttacagcgcccacatttcctcaggcatcctcatgacaccaaacaaaaatgaaaacctgcaggatactccggatatcaccagggagctttacaaggatcttccccctgccctgatcagcacctttcagcgctcctataactggatgctgaaacagatcgaggagaccggcctgcacggaaaagtgatcgcggagacttacatcaatgcctggttttttatacacaaccatctggatcatctacccacagacagcctgtacatagtcatagacaaatatccggaaacacttctcatgtacaagcatctcatagaacgccagaaaccggagctggacatcctgtatctggcagattccagcacccgttttccgctgaaagaaaactgcatagatgtgcatcttgatttctttgcggcaaatgaacataatttttatcacgacacttttttatatgaaaggatcgctccctatctgactgcccgggcggaattgatcggcacctatttctactttgaaaacgccccgaaatccatgcgtcttctcctgagccaatatcctgagtgtagcagcagcaacttccatctggattattttctctcctccctggaaaaagcaggcttttgtctgaaggattttgaggactgcggagccgtgacggattcgggaaacaatttaggatttggatttcatgtgaagggggagaatatgcatctgatgccttatcatgccggaaaataataatatacaagccggggatactccctctcatcatcaaaaaagaggcttccgcacccatggattttcatatacaatctggggcggcagcctctttatagacattttaacgaagaatcagccatgctgtcagcagacacactgccagagcaatcagtgcactgccgagtgccagcaaaattttctgatacagcctctttccactctcctgtatcttatcaatttcatccagtctctttccctcggtaaaagctacaatttctttgtaggtttgcacatcattttcttttttcaccttttctaccttcagggcaaaatacatcgtgacaccaaacaggataactccggccgccatcccataaacatcaaaccacaggacaaggggtactgcggaaatgatcgtaaccactaagagaattgtaaagattgttccataccggttcagtttgttgatttccacttctttgatctcttctttcattatctcgatatctccttttataagttgatccagagatacattaaataatgagcctagtaggagcagactgtgtatgtccggataactctttccgttttcccaatttgaaatcgtctgcctggttacatataccttttcagccaattcttcctgggataatttcatacctgcccgatatttcctgatctgcgtattcagctccaatgtttctgcctcctcgtttttatttgttctctcgacctgtatccagtataggagtttcaggctatcatttctatcaaagtccttttacatagctgtaaatacgtgtgtcaaaagtattttacatcacatgatccgcactatatccccacttttgatgtgcagataacaatattattatacatcaactctttcctgtttggaaacaggataactccggcagatcactaaatccggtgcatacacaaatctctctgtaaaagcagaaaaagcagccccccaaaaaataataggcggctgctttacatttactgcgctttggaagctctgcggctctccagttctttctggatggaaggaaattccctgtccagcctgtagaagatcaaaataactattaatacgatataaaccccaataggcacaaaacggaaaaaggtatctatccccgtcaccgcagacgcggcctgcacttctgccagtccgtcatacccgatagccgtcaggaaaaatccaaatgcagaagtcaagatcccctgtgccagcttttcggacacggattttgcggaaaacagcacaccctgtacacggacaccggtcttccattccccgtactctatggtgtcccctgtcatggcattgaccaggcccataataaaggcaaacccaataccacgggcaagagcagtcccaagaagaatactgatattatgattcggagcagcacagaatacgatctgcgcacccagacacagtacagtacccatgaatgccaggttccgttttgacactttgtgcagaaagcttggaagcactatcataactattacccccggcagattggataaggtcacgtaggtacccatcagcgccagattgcccactacattctgcagataatatacagagatagaaagattaaacatgagctgaagggaacagcagatctgtatcaccactgtcatcagccagtatttattgcggaacgctactttcacactctgaaggatattttccggctgagcttcattgtcaatgcgctcttttacaaaaaatgcattcagatacagaaaaacaaggcctacaagaccgaatacaagactggcctttacccacgcaccctgggatttctgaccgccgaacagatccaccagcggcagaatagcgtttgccatgaccatctgtgtggcagcggcaaaaagcatcttgtagcagagcatctgggaacgggatacagaatcatctgtggcataggatgccagcgtattatgagccagtcccacaaaagtatacataaccgtattgaacaggttataggtcacaaacgcaaacaatacccgcaccgcaatactggtatccggaaccaggaaaaccagcacgctggtaacaacaaggggtatactccatttcatcagaataggaatgcagtgccctccttttcctttatgcgtgtcgatccattgacccgcgatcagatctgaaatcccatcaaaaatcttagaagccagaataacagacccgatgatcgccgcattcataccgataacgtctgtgtaaaaataaagcacataagagctgaacaaggtatacatggcgttcagtccaatatccccggagccgtacaacactttttcaaaaatactgatctttttagacatcttttgtccctccttacttccctaatcttttatctattcaggcaatactgtatgaactcatgggccagattgcacatcttttctgtccagaactcagcgccgccgtggtctgcaccctccagcagatataagcggacatccttgccgcatgctttcattttctcaaaaagctgtacgctctggtatgtattcactgtcctgtccttggttccgtgtacgatcatggtgggggccatttcaagctctggtgtaatataacactccacagagcctttttggcaaagttcagggtgctctttaagatttacctttcccatgagcattccttccgggctgtcttccaaatggtgattcaccgtggatggatacccatcctcatacatcatactgatggaaccgtaataatttagtatacccttcacatctgctgaaactcccggaaaaagactttcgtccagttccccgccgtccttgacaattccgcagaacatagatgtatgtccacctgaggaatccccgccgactatgatcgcatctgcatccacatgataatccgaagcatggctcctcatataccgtatggcatttcttgcatcctgaacctgtgcaggaaacggggcaataccggaatggcggtactgtacaacagctatcacataacccttctttgccagcccggacagcatggggcactgcatccacacatcctgttccatccaggcagatccctggacaaataccatacaagggtatcttttatccggctcatttctggtaaagggaaccaggatctgcaggtgcagaggcacattgctgactctggcatattccacgtcgtgtagataacgaacgcccacctcgtctcctgttgtcttttgcatcactgctcccggtacctgctctgtatatccgggatactcctcataagtccatgatttgatttccattttgacacctccgtcttttcttatcgaaaagtctaacatatattttgcccataatctcccgctcaacaatccagttttatcatgtatggcgtttatcttttctgcatcaacagcttacccagcctttttaacagcaataaacccatataaataaagcatataaacaggattatttcccaaaaataaaaggaccgggaaatttccagtccttttatctcttatttatacatattaacctgatttcatgcggttctaaaagtgcagaaaaatcaagtctgcccgtatccatgacctgaaaccgtccgtactggtacctgggcactgccagcctctccaaatactccctctgacgctctgtaaactccttgggtgctcccaggctcatccacagatcatagctgctcccgtattcccggttcaccacatagctttccatatcataactgccctcttccagtctctgcagatggatccggaaactaagccctccctcatcacggaaactgtaatatctgtcaaaggtcctctgttcttcctcaggaatctgggatgtgatccgcgtctgtttgtcatagtgacagtaatgatacaacaggatccgaatgcggcggcagtccctggaacgggtaacggtataaccgcttcctgattccaccaggatctcttccagcccgttgagcatactatatgcctgataacccgccttgggaagattctggtaggttataaggccgtatcctccatgaaaaacgtttgggtttgcaaatagcttctcagaataatctgtgagatagttaaaggccagtgccttcacagaccctgcattttccagcacattcttgacaataaacgcagctttaaagcatgtgtcatttcccaggtctctctgccatatggtagaattccaactgttgatcacaataggcagccccgcgcctccattttcatccaggatctgacgaaccgcttttatctcttttgacagaatatccgggtcctcactgaccggtatcggctccctgctttcatttccctcctgtgaagagatcctgatttctgtctctcctttatcaatccctctgtaatcactgtgaaaacattggaaactgaattcattcggcatacagtcatgttccgcacagaatttcacaaaatcccggagcgtactgtcacccggcagtgtgactgcccctgtatccagcccaaaggcggagatgcaggcatccggcaggatacgccggatggctctggctgtactgcagtaataatccagatattccctttcagaaaacacgccgtaaaaggaatacaccgcaggagatggggaaaacctccactctttgacctccaaaatcccataacgctctatcagatgccgcataaacccctctatcaaaaacacccatctctcctgatcaaaaggcagattaatacatgacgtcccgaaaatatttttgatatgggaaaccagctttttcggtgtatagccaagctcaatccatggttttatacctatggctatctcaaaatcaaaaatcatatcaatataagtaaagttcagatacggagtcccatccggcttctcgtgatagacatccatactgtcatccagtattccatgggtgaacagatagcaaaatcctatctcttccctggccctgcgcaccgcactgcggacaggttccagcataagatccctggcccagcccacactggcagcctccctgtgacagaggacacagggcgtatttccttttctcacatcaatctctaactgcatgggctcctcgatccgcttatttagcggctgcagctctcccgcatactgaatatgccgaaacagactaatataggacacctcatccgcagcttcctgctgttctcccccttttgcagtttcagaactttttttttctgaatactcccggcgtacatccatactgccgcttgaatccctcgatcattgtattcgtgttggaaaaaccgcaggccagagccacatccgttatggaaacggaggactgtaacagcatatacgccgctttgctcaaacgcagatttctcagataatctgaaaaggccatacctgtcagtctctgaaattctctggataaatggctctgggaaagataaaaatgagaggccagttcctgcagtgacatctcttccgcataatgttttccaatatagagcagaacttctctcatacgctctgtccctgccccgccccgtgtccctttttcttccttcctctcaaactgctgctttaaaatacccagaagcccgaacagctcgcttaagatatataggcgccgctccccctgactctgcctgtgatccctgaagatcagagccagtttcacccgaagaagcccaaaccactcctcctgttccggctgcaggttgctgatacaccgaacactccccacctgtgcctgcagcataacttccagggaaatatatgccgataacgtatggctgccagcttcccggtacagttcgtgatgctgaaagctgttaaaaaccacaagcgcttccggccccatcacaaaattctctccttctgtcatcacagccactctgcctgacagcacatacaggatttccacctcttcatggaaatgtagtgttcctaaatcacagtccagttcaaaacgaatttcattcatttatgttgtctcctgattccttttcctgccgcaccgccaaaacttaaagcgcaatgctcaggtgtaggtcctttttcccttttacattaaacacgatcctccactggatctcttccacttttttaaaatggagagatgaatatactgtgcttgtctctttacatctgccggcctgtgagtccattgcaggaccctccataccaccaatgactgagacactcattgctgacgcatttattatttcctctccacatttttttggtgcatcactttgggatgtatcctgaatgtaaaaatccctgcctgcaatttcaggtgatactctataagtaagcatctgcatattatcaggcaatatcatttcctccctgtccgggaacatatgtcctgagttttcaggcaattttccgaattcgcatccgcaaatctccaacctgtatttttcatgcgtcaccggatgagtgaaacttatcttttttccggcatctccaacttttgtgataaagtggtctgcggtatatggcattggttctgactgaaagataaggtcaagagtgtgaatctctgtctgccgctctgcctcccatagataaaagcagcgaacaaatttccataccccatctctgtcacagccatagtggttcataaaaaattctgcctcctggtcaatccctcctctttcatctgtaaatggatgccagccaactgcatacatattcttccacttcaaactgcttccatttactttacatttcactttaaatctttccaaaaagggattctctctttccagttcatccatctcttcatttgtcaagtaagacgtccttcgctcaaaattccattttttaaaatattgttccgcatcgtcccgtgggatggaaagacagatatccataaccattccttccggaaaaacatacagggacgctgcagatcccttctggccttcccaaacaaaatctttgttcaattttatttctttccccggctgccctgatcttctgtttcttgaaatactgtcatcaaaatatacttccataattctcctgattccatcggcttcactctcagcacgactctcccattacttttccagatttataagctctaatatctatatctatcatacatgcgcggaataaagaatgcaaagacctttttcaaaaaccatatgaaccgttttacaccaatatacaaaaagggaaatatactcccaataatctcaaaagtatatttccctggaattccataaatattttttaattgctttttttacttttaattgttttactgcttttaatttccctcaatcactcttgatcacacctgacggttcttaaatcccctatgccgcatcatgttatttaacatctcattatttaaagaacttctcggccgcctggatcagataataagtatccttgaccccggctgtctcataaggagaatgcatggcaagctgcggaaggccgatatccactgcgttcagcgccacttttgtattggagatgttccccagtgtggagcctcccagcatgtcggaacggtttgtgaaggtctggaaaggcacaccagcctctctgcataagtccttgaagaccgcggctgaaacaccgtctgtacagtatttctgatttgcgctgtgtttgatgacaataccctcgttcatatatggacggttcaccggatccgccacttccttgtgattgggatggactgcatgggcattgtcagcggagagcataaagctctttgcaagtgctctcagatattcctcataggacagacccaggcactcatttatacgtaccagtgtgtcatacaggaaagtggaagccgcaccctgttttgttccgcttcccacttcctcattgtcaagcacacagtgaactgccgcgtactcttttttctctccctttaaaaatccctgaagagaggagaacgcgcactgcagatcatccagacgtgatgaggagacaaattcctcattggctccccagatactgccctttacacggttgtacaggaaaatgtcatgtcccagaatgtcctcttccttcacacctgcggcctctgctattgacttcataaaagtatcttttgatgagatatcaccatacagaggaagcatatccacctgggcattatatttatacccgtcattgacttctctgttcatgtgtatcgccagattggggatcatcaaaaggtctctgtccacatccacaaattttgtaacaaaggcatccccctctttcacaataactcttcccgctacagacagcggacggtcaaaccacggtgcgcagagcattccgccgtagcgctccacattcagtttcacatactttttgtctacttccatctccgggttttctttgatcttaaaagtaggcgaatcgctgtggctggccatgatgcggtatcccaaagctcctgtctcaggtatggtaaatgccacgatggaggagtcatttctggtgacaaagtatttacccccatttacgatttcccatttatcttcctctctcagctgggcaaatccttctgccaaaagaatgtccttcatatttttgatggcgtgaaagcagcttgggcttttttcaataaacgccagaagctgttctgctgtctctctgtacataaaattttcctccttaaatgctgccctatacccgggcttattatcttctattgtacctgtccggccgggttctgccaacaggaattttcatacaacaaacgcccggctgccctcaggcagccagatgctctttctgcagtggtatgagttgccgcacacccctgcccttatttatgcctgcccctttgctttggaacgttttgcgatctgaggcataatgaatcccagtccgatcagtacgaagggagtcacaatgttcagcacaaactggaaggtatcctcagagtagatgcccagaatacacgcaaacgcggtaaacaggaagcaccatgctcccaggatcacacccagagtcctgttcttcacaaaacggtactgtgccgggaacttctcccctgctttcttcagggcaatgtatgccacaaatacccacagataacgaagaggcatacaaacagagttcacctttaccagccagcgcaccagggtatccacacttccgataccgatggccggaacaatgatcaaaatggatacaatgatcatgaccagcttgtggccgtttgtatatgtgccgtgcttattctgcttgaacatggatgcagggatgtaattgtcatccgcattgtcaagcagcatacgaagaggcgcgtcgatggagatgatcataactgtaaactgtccgatcagattacagatcgcatagaccaccacaaagaagttgcccagtccgtaatactctcccagtgtctggaatgcatagtatgcaccgtttgtcataaggtcttccggaatgttgttggagtcaaacatcatacccatggcaatggttcccagcatagcacagacagcaaccatgatagccagggcgatcatacccttcgagaaatccttggcaggattcttagtcttattaacatacggagaaatcttctcacatccgcccaccgcaaacaccaggatggacaggtttaataagaacttcgcgtcaaaggacggcataaaggtcttcacagaccaatctatatccagtacatttgcatgagtgatcgcaggagctgccagcatcatgaccacaaacagcagggacatgataaacatagtggaacccgccagtgtggagagctttttcagcacattgatccctctggatgctacccaaacggcaaacaggaataataccagacataaaacctgcagcactcttgtgttcatggagctgatccggttgtccctgaagattgcccagcttgctgcaataaaggaagcacttggcttctgggaaatataaggcatgtggacgatccagtatgtccacccggccatgtaagccattctcgggcttatggtctccaggatccaggagctgacaccgccgcccgcatccttgaacgcactgcccagttcacctaccatcagtgcatatggcacaaagtaaatggcaaatatgatcacccaggatatgattgcctttaatccgccgtattcagagaatccattgatcacattaccgaatccccatacagtggaaaatgccataaatgcaaggctgtaccacaagattttcttttcactttcttgttgtttcattttctacctctccttgattttttctcccggattttatcagtctcaccgggaatcgccagcctgttcaaggtaccaaaacaactgtctaaatatcgtcaaaattcgccttttttgcaattatcagtgccaattcctgcaattcccatggctactttttccggtgtaatgggcatctctgaaaccctcacccctgtggcgttacagactgccgccgcgatagcgggacagggggtgtcaattacgatctcaccgatggatttggcgccaaagggatggcttccttcaaaactgctctcaaaatccacgcggatcttccccacatcgagacgtgtgggaatcttgtactgcatcagggagttgttcagcatctgtccccgttcactgtattggatgtcctcaaagagagccataccgataccctgggcgatcccgccttctgtctgtactctggcaaggttgggattgatcggtgtgccgcagtccacaactgccacgtaatcgatcatttccacagctcctgtctccctgtccacttccacttctgccatacctaccataaacggcggcggggagatgggtgaggaggcattctctgtcacctgaagggagtcattgtttccgaaggttccccggataccgatctcttccaggctgactgctgcgcttccgtcttttctgcacactttgctgccgtcaaattctgtgtcctctttgggtgtctccagcatttcagcacccagattccagatacgctccctgagattttcacaggccttcaccactgcttttccggcaatatatgtggtagctgatgcgtaagaaccggaatcatagggggatatatccgtatccaccccaaacactacgatattgtcaagctctgtcaaaagggtatcggcagccatctgggagagcactgtatcacatccggttcccatatccgtagcacccagactcagggtataggagccgtcctcattgagcttcacagaggcccctcccacatcaacgcctgcgatagaagaaccctgcatagccatggctacacccacaccgcgcactttgccgttttccatgacacggcacgggtatttatcattccaaccgaacatctcttttgcccttgccatgcagcgatccagagcacagcttgtaacctctgtgccaccgtcatatccgatgaatctgccgccctcttttgtcatatttttctcacgcaggaccactgggtccatatgcagcttttccgccagttcattaacggctgattccactgcgaaaataccctgggtagccccgtatcctctgtaagcgccggctgacatctggttggtgtagacaacgtcatacacaaaacggtacgcctccgtattcctgtaaagggcaatggatttgtgcccggaaaggcccactgtggtgggtccatgctcaccaaaggcacctgtatttgacagtgtatagacatctatggccctgatcgttccctccctgtctgctccaatgcggaccttcagttccatctcatgccggggagaggaacatatctgggattcgtagcgggaaaatatcattttcgccggctttcctgtcttcactgtcacgatcgccggatacacctcagacaccagtgtctgcttcgcgccgaacccaccgccgatacgcggcttgatcacccggactttagaggccccgatcccaagtgcccgtcccaggatccttctcacatggaagggaacctgagtagaagacactatattcagtcttccgaaatgatccatataggtatagctgcggaatgtctccatcatggcctgctgatttgcctttgtatggtatgtccgttccaccacacagtcacagtccgccagaatcttgtccacatccccgtcaccttcctcggcgtgggcacagagattccgtttgttgtcagcgcccacagggaatcgtgactcccagttgtcttccgggtggatacaaatctcattgtccttagcctcatggaaatccagaaccggctccagcaccttatatttcaccttgatgatcttcagtgccctgtccacagccttttccgtctcccctgcaacaatggcagcggcatctcctacaaagcgcactcttctgtcaaggatcagcctgtcataagggctgaattccggatatgtctgacccgccatggtgaatctgtcctgaggcacatccttgtaagtgaggatacatgctatccccggaaccttcatggcattttccgttttgatctcctcgatccacgcgtgggcatggggactgcgcaggacttttacaataaggcagtccttgggtgccagatcatccgtatacaccggctgaccggtcacaagagccatggcatccttttttctcaccggtttgtttacataactcatctgtcactgcccccttccctctgttccttcttatatttcaaaaactccaggatactccttgtctgccccataaacccggaacacctgcagaggtttccggccagatactcgccgatctcctcctctgtaggttcctctgtctcctccagcatggcaaagacattcatgataaaacccggattgcaaaagccgcactgctctgctccctggtctgccagaaaagaaccgaactcctccgcttccttctgcattccctctagtgttacgatctcacacccgtctgcgcggactgccagcatactgcaggaaagcacaggctttttgtccatcaggacagtacagagaccacagtttgcagtctcacatccccgcttcacactgtagcagcccttttcccgcagaaggtccaggagcatcagatccggtgctacctccgcctggattttcctgccgtttaaagtaaatttaatttccattttcaatacctcctgcctctaacagcgccctttttgtcaggacacggaccagatgggttctgtactctttggaagcccgcatattgcttcctgtggtgatactctcagccgccttttccgccagccgctcagcctggcttttccactcctcggcatccatgtttttcttattgacaggggtgtctgtcttctctttcaaaagcaccgctctgccgggtcttgctccgatggaaagccgcataccttcctcgtcaagacataccgcacaggccagtacaggaaaatctgtttttgtattcctctgactcagatacacggacttctggggatgcttcttaatgatgatgttcaccagaatatccctgtccgcttttctctctgcaaactcttccatggaaatcctgccgcctttgtacagctccacataggagtccagtgccagaaacatagtgagcacatcagaaaatccaaatctgccgtaaatgctgccgccggcagtggcacagtttctgaactgcacccccacgatgtgccgcaggctctcccgcatggcgccgcccgtataggtgtttatccccgggtgggtttccagcgtccgcagggaggtcatacagccaatcacaaattcctcctctgtctctgtaatcctatccagtcccagcccagacagatcaatggcggtccccacactccggttcatcatcttcatccagaccattcccccaagcacgcgggaggattttttctggttcagctcataggcttcctccagactgttcaccttcacatactctttaatcttcagcataatccattcctctccgttttttgtcagtccgccgctttttcaggcagacatcactaaaaaacactgctgatgcagtgctcccaaaagtcattctatcgctctctttgagggaattataacataggccatttgagaggcgcaagctgttttgccgcttccgggcaggattcatacaaatcctttaaatactgatgacaaatttctgctttttatttataatgaatagataatgtaaaatccaccgacagacaaaatgccggacagaaaaggcagatgataccaatgaaaaacaactctgacatacggaatatcctgatcatatcatttttatttatgatcagcataatacctctggggatcctgacggatgcctcccaggaaacctttgcctgcgccccgcttccggacagggattacgcttctcccaaactggaactgggatatgaaacattggagaacatggcagattatatgcttgtggaatccgacatttcggaatatcccctctccgtaagcattcctgagggcagtacggctgacagtatcctggcttcctttctggaggcctatggactgaatgaagaaaacttttctttcttctactacaacacatttacacaggaaacttatctttacaaccctgacaccctttttaccgcggccagtacagtaaaggtgccagtcaatatgctctactatgacgcggtcaacagcggagagcggactcttgaggacggactcccctacaatgcctcagccacagatacggacggtgacggttccacgccctatgactaccgtcccggcagcctggtccccctgtcctatctcatggaggagagcatcgtattcagtgacaataccgcaaataacattatgatccaaaacctgggaggggtttttgcttaccggaacatgatgctgaagtattcagataatacttacccggatgagttttttacaggcaacaaactgtgtgccggtttttcttttgatgtcatgagttatctctattcccattcctctgcgtacgaaccgctgctggaatacatgaaagaagcagcacccggaaccttcctccagaaaaacattgacctggacttattcccggttgcgcacaaatacggagattatggcggatgccgccatgactatgggatcatctatactccggctccgtttctgatcggagtcttcacagaccacgtggcagatgccgagaatctcattgcggagatcggcgagacatacctctgctatacgctgagtgttacggaaccatcctacataaaaatatccgaggttccgtcctcataacgattcagcagccgggccgaaccccattgccaaaggcggctgaaggtactgaaccgttacccttcatcataatatatagaaacgaaaggatactgaaaacatgaaacagacaactgacctgggcagggacaaggtatggctgctggtcctcaaactggcggtcccctctatgatcgcacagttcgtcaccgtactttacagtattattgacaggatgttcattggaaacattcctaagatcggagatctggcacttgcgggagtgggaatctgtggacccattgtcacacttctcacctcctagtataataatggtgtagtcaagaatgactactggttaatagttacaaagtccaatctaataaatctatatagatataacggaaggaggagttccccctccatcagaagttataaagtaacattatttaccatgtctgaggtttccttaatgcaccagacaaaagatagaggtataatcactggaggcaggatcattgacgacacctccttgggaaccggccttccggctggtgaaacctcttagaaagtctgtcagtccattcggtggtgatttatgttttggctggttgggaagccccaggctaatacctgtataaaccgctaggttgtgtatccaccttttggaaatggatgcctgccagaaaggataaaaccatgaaatacccaaaagtacttatgatgcttgaaagcatcccttatctctcagtcgggcttgatgtcggtgcagacttcacctggatgtccatcatgctgcccaatggcattctcaccgggaaaccttttaagatcattcattctgatccgcagtcccgtgagcttgctgtcgcaaaaataaaggaagcacaagagatgtattccctcgaaagccgctgcttccttgagtccaccgggatctaccacatcccgctcctgtacttccttcgtgataaggggtttgactgctcagtcattaatcctatcatcactaagaatagcacaaatatgaacgtaaggaaactgcataatgataaatttgattcaaaaaaagctgccaaagtcggcctggatgcttcccttaagacttccatcataccagatgatgaggtcattgacctgcgcaacctggtacgggactactattacttcaaagacctgcagtccgctgtcgtcctgaagctcacggcggaactgaaagtgtcctttcctgcataccggaaggtgtttagcaaggtcactacccaaacttccttaaagcttctggaagcttacccccttgccgcagacatgcttgccgccccaaaagacatacttgtggaaaccatacgcaaaaccgcacgtttcggtgaaaaatatgccgtttccaaatatgatgccatacgtgctgccgcaaaggacgccgctgttttcggacgtgcgcttcaaagcagtgcactccggatccgactgtatatcaaaacctaccgggaataccaggagcatctggacaatatacttgaggacctgcataaggctgttgataagctggaagggacgccggtttatgaccgtatcttccttctccagtccctacgtggtgtcggttttctcagtgcagccgtcctgatcgctgaaatgggctcctttgacctgttttcttccccaaagaagctttatgcttacttcggcttggatcctgccgtgaagcaatccggcaagttcaatggggataaagtccacatgtccaagaggggttctagccttgccaggcgtatcctgcatatggtggctatcaataatcttaaggtggataaagggacaaaaacaccagtaaatccagttatccacggctattataccgacaaatgcaaaagcaagaagaaaaacgtggctgtcggggctgtcatgcataaaatctgcaatatcatttttgccatgctccgggataataaaccatttgagatcatcactcctcaggaacactgtgagcggtatctggcagcgcatcccgacaagatacagaacgcagcctaacaggtttatcatgaattttaaagatttccacatgggtgggcttattaaagttacccttttttacatcaactgcttgaaaaaaacttttttaacatttttcattttacctattgacatttcttagctggactttggaacccttatagggctaggaggctctattctcatgtccatgcgtctgggagccggacgaaaaaaacaggctcagtccatactggcccacagttttgctatgctggtggttttctccgctgtgctgacactgctctttcttctgacgaagaagtatcttctgctttggttcggagcaagtgccgcaacctttgtatacgcggacacctatctcaccatctacacagcgggaacgtttttcgccctcatggccattggtctgaactattttatcacttgtcagggatttcccggtgtgggaatgacaactgtgctgatcggtgctgtcacaaatatcatcctggacccggtctttatcttcggtctgcatatggatgtggcaggcgctgccatcgccactgttattgcacagtttgcatcctgcgcctttgccttctgctttctcataggcaaaaaagttcctattcggataacaagactccgaaagcccgcctggtcccccatgatcgttaagaggatcctggttctgggggtttccccgttcctgatcctggctactgacagtgtcatcattattgttctgaacgccatgctgcagaagtacggaggccccggtgagggggatatgctcatcacctgtgccaccattgtccagagctatatgatgctcattacaggtcctatgctgggaatctccagcggaacacaggctatcctcagctataattacggcgcaaaagctgtggacagggttaagaaggcagaaaaatatattctgctgctgtgcctctgttttaccaccgtgatgtttatcctctccaggatcgtgcccggatactttatcaggatctttaccagtgagccgtccctggtatccctgtccacttggggcatccatgtatttacactgctgatcattcccctcagcttccagtatgtatttgtggatggctttacagccctggggctttccaggaccgccctgttcttatccatgttccgaaaaggggattatatgctctttacaatttttctgcccatttttttcggagccaaaagcgcgttttacgcccagcccatcgcggacgggatcgcctctgtcatggcgactgccgcattcttcctatttttccgcaagcatctggaaaagcgcctccggcaatgagcttctgctttgccaaaatctttcgttgacattttgctgaaatactttaaaatattagaaaacaggaaaggggatgtaactgatgaaagacaagctgaaatattttctcctgcttctgctgtcagttctgtgtctgtccatactgggcgcctgcggcaaggacgacagcgctgcagaggaagaggcagcactggattccgtatctgcctccatggacggaactgtgacagcttttaccggaaaagagatcagtattattacttcagataatgataagctgacttttgatatgacaaaagcggaacttgactgcaagagcggaattattcccggcaatgaggtaacgctgatctatgtaggtcccctggatgggacggataccagcaaagtccgtcttaggaagatcatcacaacggatgataattcaggccttctgcctacagacgggacaaaagtgatttcacccagcggtgacgcggatggatttcaatccggcaaggccggttatgatgagccggattccggcgtcaaggtagaggaaaagacagaaaccgttacagtaaaaagccctgtaaacgtaagggctgacgcggcaagccaggcccaggtcctgggagttctccagggcggcaccactgttacgcggaccggtatctgcgacaacggatggcataggatcgtctatgaaggggagacagggtatgtgtggggagattatctctctgactgagcataatgaaacagaccgggaagaatcatgttctccccggtctgttttcttctattctttattttctgcaaataagccggttgatctgggcacccatgtaacctcccccgaaaccgttgtctatatttaccacagagatcccttccgcacaggaattcagcatcgtaagaagtgctgagagtccgccgaaattagccccatatcctatggaggtgggcactgcgatgactgggacttccaccagtccggcaaccacgccggccagagcgccctccattcctgccacagccacaatggcgttggcatgacggaggcgttcctgttgtgagaggaggcgatggatccccgctacccctacatcgtagatacgctccacattggcgccgaaatattctgctgtcctggctgcctcctcggcaacggggatatcggacgtgccgcctgtgcagacagctacgcacccctcttttgcagcatcctctttctcaatgacaagtatatgggaaagagggtcgtactgcacctggggaagtacctccttcacagccagatactggtcctctctggctcttgtacccaggacacagccatcctgctggtaaaaatgctggtagatgccaatcagatgatctgtggctttaccggaacagaacacaacctcaccgaacccggaacgtatcttgcggtgatggtccagttttgcatagcccagatcctcgtaaggaatcttctccagcatatgctccgcggtttccagcggcatctctccgcttttcacctgaagcagtatatcttgaatgttcatacttattccctctttataagatttcaatgccggctttgctgcaggcagtcagggtcgcttcgtcccaaatggaggactgtacctctcccacatgcactttctgcagaaggagcatacaaactctggactgaccaatgccgccgccgatggtcaggggcagttcgttgtttaaaagcattctgtggaacgtcaggttcctgcgctcattgcagccggctttttcaagctgttcgctgagtgtttgagcatccacccggattcccatggaggagatttccatggcgcactgcagcggctcatgccagaataaaaggtctccgtttaacttccagtcatcatagtccggcgcacgtccgtcgtgcttttctcctgatttcagcagatcacctatctgcatgatgaatatagtcttcttctccttggcgtaggcgctctccctctcctttggagtcatatcaggatacatatcctccagttcctgggaagtgatgaaggatacctcacggcacagctctgtgtccagattttcatagtggtatttcacctcttccagagcgttgcagatggaattcacgatcctggtcactgtatcctttaggtaatccagatttctgtcctctgccgtgatgattttttcccagtcccactggtccacatacgcagaatgcagattgtcaagctcctcatctctgcggatggcgttcatatcgcataagattccttttcccacgtggaaatcatagcggtaaagagccatacgtttccattttgccagggaatgtactacctgtgcattcatatttgcatccgggatatcaaatgttacagggcgctccacaccgttcaaatcatcattcaggccggaagccgggtctacgaaaaccggcgctgtcactcttttcagattcaaagccaaacatagtttcttctgcatcagattcttgatgataccaatcgcttcctgtgtctcatagctggataagcatgaatgatagttctctggtattgttacttttcccatgtttctttcctcccgtttttatgttctatggaataacaactgttttttattttattataaaaaagcagtgttgtaaatagtcaattcccctgatcaaccttcttgatccgcttcctgtaagcggctgcaaggatcaccatagcccccagccaggcacctgtttccgcaaaatagatgccctcttttcctattaaaaggggcagaagcagagcaatgagtatcctcatgaccagctctgcgatcccggaacacatgggtataagggtatcacccatgccctgcagcgcagagcggtatatatggagcagatagagaatgatcagtgttgcccccatgaccgccagataattatatgcgatagccagcacttctgatgcattggacgcctctgaggagataaatattttcaggatgctgcgcccgaaaacaaggaggacagcaccgatgaccacagcgatccctatggatattttagctgaggcgcggacgccctccttaatcctgccgtattccccagctcccagattctgtcccacaaaagaagatgtggcatacccgaaggagactgccgccagctccagaagtccgtacagtttgttggttgccgtaaagcctgccacgtacaaaaggccgaaaccattgatcacatattggatcacgatgcccccgaagcctatgatcacattctgaaatgccaccggaatcccaagacccagcagatgacctgccatctcccagtcccatttccaatctgttttttctatgtgccagatgccgtattttttaagctggataaaacagatcgtgccagaacacacctgagccagcacagttcccagcgcggctccctccacgccccagtggaataccagcacaaatataagatccaggataatatttacggcagacgcaccgatcatggcacgaaggggcgtctggctgtcacccatggcccgaaggataccggaacagatattgtaaagcgccgtagccgccagtccgaacataaggatcagcagataattgtaggctggctcccggatattatccggaacgcgaagaagccccagcagcgctgacagattgctgataaagagagccatgatcaggactgtgatcagactccctgtccacacggacattgccactgcctttttcaggcgcttttcgtcctttgccccgaaacactgggaaataagtacggaaaatccctgtgccacacctgtgatcccgcccatggccgtaaaactcagccagtctgaggtccccagcgcggcaagggcctccacgcctacgccccgtcctacaataacactgtccattacggtatatagctgctggaatacatttcccagcatcaggggaagggcaaaggaaacgataatacctgccggcttcccgcttgtcatatctcttgtcttttgtctcatcacattctccccttacttgacttgtccagcctgctgccctgtcttccaaaacgcttttggcagccctcttccttctgctcacagcgcggcaaaaaaacacagcctgcagagatgtattatatcacttttgcaggctgtgcggtagacattattcgattctatttttcacactattttccaaggcggatcacattccaggatgcttttttcagcacactggtgacaatgcctccgtccagtttgctgcggtcatccgcatttgccggagcgactttttccattcccaggccgtttactgctttcaggtcctcattttccagaacaatatgctccagaatgcggtatccctcaaagcttctcacatctgtagccagttccacatcctcttccagattacggttcacagcaaagatggtcacctcatctgcctcttcattgtagacagcaacggattccacgtcagtgatctcatcatgttttgctgtggcatgtttcgtgctgttcataacaggcagaagcgccacacctcgtccgtatttggaagcgtgcatgaacggatagaaaatggtctgtttccatgcgccgccagcggcatctgtcatgatgggagcgatcacatttacgagctgcgcaaggcatgccatcttcacacggtccgcgtgtctgatcagtgtgatgagcatcagtcctaccagaagcgcatcctcaaagttatagatatcctccagcattggcggagccacctgccacgggtggttctctgtgatatcatcatccgcggcgtttgagtggaaccatacgttccattcgtcaaagctcagattcatgacttttttgctgcgttttttagcttttacatagtcacaggtggaaatgatggtgcggatgaaatcatccatatcatcagactgtgccagataatcattgctgtcatcatctctgtttccgtaatactgatgcatggaaatataatccacgtagtcatatgtatgggacaaagtaacagcctcccagtcagggaatgtaggcatgtcacggttggagcttccacaggatacaagctcgatggatgggtcaataagacgcattgcctttgcagtctcctcagccagacgtccgtactcatccatggtcttgtgcccgatctgccacggtccgtccatctcattgcccaggcaccataccttgatgttgtgcgggtcctttacaccgtggctgatacgcatgtcactgtattttgttcctgacggatggttgcagtattccagcaggttacaggcatcggaaatgccccttgttcccaggttcactgccatcatcacctcagagtttgcctgttttgcccatttagaaaattcattaaggccaacctcatttttctccaggcttctccaggccagttccaggcggtggggacgatctgccaccgggcctacggaatcttcccagtagaaattagaaacaaagtttccgcccggatagcggataatgggcacatccagctcttttacaagctgcagcacgtcctgacggaatccgtccttgtccgctgccggatgtcccggctgatagatgccttcgtacacggcacgtcccagatgctcaatgaaagaaccataaatcctcttgtctacaggtgcgatacgaaattccttatcaagcaccatctttgcacgtctgctcataattaaaaacctccggttttctatactcttttcttttattatactagttgtatggtcatatcaacaagttgttgataaaaaaaccgcaaaagcttttccgcatcattccatgcgtccggcttttgcggcagtcagacttcagtccggcatcagccttttacagcgccggtcgtaagaccctctataaaatacctctggaaacaaaggaatatgacaaaaataggtatgatcgcgaacatggaacctgcgatcagcacatcatagttgttgccgtaaggcgtgagcagtgtgttcaaaccgatcggcagcgtaaatttgttagcatcacggaaaatcatcataggccacagcatattattccatgcacccatagcacagagaattgtcatagcggcaaatgccggtttcgtgatgggcagcatgatcttaaaacaaattccgtattctgtagcaccgtcaatccttcctgcatccagcagctctttcggcagtccgatcatatactgccggaagaaaaacacagtagacgcaccacatataccgggcaatataacgcctgcagaagtattcatcagtttcagatcgatcatttcctgatacagtggaagcataagaatttcaaatggaaccatcatagttgcaattaccaggaaaaaaagaacattttttaatctaaattcatacatggaaagtccataagctaccagataacagataagcagtgtcagtactactgtaaccacagtcagtaccaaactgttcttaaaccacataaaatactttttggaatctgcatttccggaaaacaggtatgtataattgctgagcgtcatagatgaaaaatcaaggttcacactgaggcctcttcggatcaattcacgtccgggtctgaaggatgccagaagaccggcgagcagcggaaacaccactataaatcccaatacagcaaaaaaggcagttgatatcacagataaaatcgtattcttctttttcatacccattttttctttttcagaggaaactgtactcataatcatctctcctccttcttaaatgtgccgtttaatattaactgtacaaagttgataataagtgcaatcaccaaaagcacaacaccaactgctgcagcatatcccatctggtttctctcaatacccctcttgtacaaatatcctacgatagtcagaccgatattcttcggcgaggaatttccgttccacaacataaaagattccaggaacattgccagtccggcatatacgctgatcgtcagaacatatatggtggttggttttaaaagaggcattgtcacataacgaaacttctgccaggaattggctccgtcaatgtctgccgactcatacaaagcaccgtcgatccctttcagtccagacacaaaatagagcatattaactccggtccaacgccagcatgccaatatcagcagagcgatcatacctgttgttccatttttcagccaggcaaccggtgctttcccgatcaattccatcaatacgttcatctgtcctgtggaatactcggagaacataaggcggaacaatgtacctgagatcaccacactggtcaatgccggtatgtaaaggattgctttccataaaccttttgcctttaccagatggctgtccatcagcacagcaaaaagcataggaaacgggatcagcaggagcaaagtaccgatcatgtatgtggcactgttcttcagcgcaatgtgaaacgcactgtcacgcagcaattttgtatagttggcaattcctacccactcgatctgtcccggttttatggactgaaagctcattttaaacgcactgaaaagcggatatatccagaatatggcaaaactcagaataaacggcagtacaaatacccacggagccgccttctgggaatagaagaatttcttaaattttctcatatattcatctccctttttaaaaactacccggagtgaaatcactccgggcaattttctgtctcgttatggtcaccctgatttatgtcagtctatatcctgctccaaatcaacgtaatcctgcgcatcctggattgcctctttcacatccataccatcctgaagtacattgttcagggtagttgtgcacatgtagtcacctaatgtaaatgtattttcatttacggtaatagctgcaatttcatctttaacctcattcagaacatcgaatgggtttgtcttaaagaaagcaatgaacttgttgcttgtatcctgtgtaatctctggatcttcccatactgcagtgttgcagacatcaaatccaaggttctcccagattcccttacagccttcttctgaacattttgcataagcgataaagtctgccgcaagttccgggtcggaggactggttcgttacaactgtacctgtaccgccgataccaacggaacgcggctgtccttcttcaaataccggacatggagccatagcccatttgccggactcctcaggcatgtaatccaggaaacggctcatgtaccataatgctttcgggaaagaagcgatgttgccatccagaatattctggaatcctgcctccagatccacatgtccgtccggagaaaccatagccagttcttcgtccagccatccctgctgcatggtaagcattttctccatagattccgggatcactgccttaccgtctttgtctacctggtcatcgccgtactcagccattgccagccacatccagtcagtaccgcctgtatccacggaagtcatcttcacctctccgtttgatgcctctttcagtgtctctgcagctgcagtatagtcatcccatgtcttaattgcagtgtagtcaactccgtattttgataaaagttcatcgttatagaacataactgtagcaccaacatgagtaggagctccatagtagttgtcatctttggaatagatgtcaaaacgtgactgcaccagatctcccatataaggttcaagagcatcattcagcggataaagctgaacttctccctgaaggaagttagggaactggcctctctcgatatcacacaaatccggtgcgccttcccctgtctgaagtgccatgatcatcttgttgtgcatatcggcaaatggatatgtagtgaaggtcatttgaatctgtcggtctggattttcctcattccatttttccagcatctgtgcatagaaggtattgtgcagttcgacgaaagaccacatctccatctttgttcctgaatcaggtcctactgttgtaactgcttccggctctgcttcgccctcttctccttccgcttctgcgtcctgtgtgtcctctgtatcggcgctgtctgtccctgcagagctagccttatctcctccgcatccagccaggagacttgtcgccatagctgtaactaataatgcactgactaatttcttcttcataccgtaacctcctaaatttctttgcaaataactgaattacttttcattttccaaaaataaacatagtaaacaaaaaacgttcttgtttttcattactaatgcactcgcgagtgtacacattgcacatttttttttttttttgtaccggtttatgttcatattgtataataccctttatcttattgtcaatatttatttatgtaaaatcaaaattagtttatatttgcttttaaacccctgtttatattttagttttatctaaacattaaatcgatctaaacagagatttattttagaaaaccccttatttatttcatattatattgacttttttagataaaaggatataatactttatataattctaaaatttaaagtcgtaaaaaagagggcctttttcttttaacttgtatggtcgtcgatacatctttcccttttttgcgcacaagactggaggaaatcaaatgctgcacattaaatcattagaagaaggactgaacatctttaaagcccttggctctgaaataagagttgaaattattaaagttttgcttaaaagcgatggtatgaatatgaatgaactggctcagcacctgaaaattaccaatggcgctctcaccagccatatacgaaagctggaagaagccggactgatttctgtagtaaacgaaaccgcatcccatggaaatcagaaaaaatgctctgttctcctggataagatattaattgacttcgagccgcagacagaaaatgcaaacatctttaatacatccatcaaagtaggtcattactctgatttccaagtaacccctacctgcggcctggcctctgccaccaatatgataggcgagatggatgacgtccgttattttgctcatccagaccactatgaagctgatattctctggttcacacagggatatgtggaatatatgatccccaacttcattccgccggcacagaaaattgaccaaattgccatttctatggaaatctgctccgaagcccccagcattaatcccaactggccctcagatatctcgttctacctgaatgacttaaagatcggttcctggatatcccccggagatttcggcgatgttcccggtaccttcacacctacctggtggctgccaagcctgaatcaatatggcctgctgaagttcctggtcatcaatgacaaaggtacctttatagacggaaaacagatttcagatgtggggatccgtagtttcaacctcacatcacaaagtttgctgcggctgaagctggcagtagagaaagatgccagccatgtaggcggtttaaccatctttgggaaaactttcggaaattacagtcaggatattgatgtacagatttcttatagtgctatagaaggataacagctgagtgttagaatagatcgtttggaagaaaaagaaaaaaccgttttgccggcatttaagctgacaaaacggtttttttaactaaaaatgatcattttattctaaaagaaactatgctgcagggcggaagtgtaaaggaaagccctttctctgttaccgaatatttgttaaatggttcttcttttacattttcaggattctcgaaagtgttatgggctctcatatcctgagtcaggatagttgctgtcacatcagtgggatttaactcagcgaatatagtttctactttttcactgtccgtaactgacaggttattcagcgtcagtgtcatgattccgtctttgtctatggatacggactcatgaagttttggtacttcgtactctccgtctgaaccttcggcaattttgttgtctgagatgtaactttccaccaggtccgcgtcctgatgggtgcagtacatgtggaatacatgataagttggtgtcaggagcattttttctccttctgtgaggatcacggattggagcacattgacaatctgagccagacatgccattttcaccctgtcacaatgtttattaaagatgtccagggtcagacctgctaccagggcatctcgcatggtgttctgctggtagaggaaaccaggatttgtacctggctcaacattgaaccagcagccccattcgtccactgccataccgattcttttctccgggtcgtatttgtccatgatcgcgccgtggcggttgatcagttcttccatataaagcgctttattcaaactcttgtaccatactttctcgtcaaagtctgttgcgcttcccttgatctcccagccttcgggatggacatagtaatgaagagacagcatattcataaagcctttatccttttcatttcccggctgcggctgggcaaaacaggtgtttaatacgccttctgtccagaaataatcagccacattggctccgcagcatactttctgaataggattttcattattatagttgcgaacataggtctggtatctgcggtacagattcccataatactccggtgtcatatttccaccgcatccccagttctcattacccacgccaaaataatcaattttccacggcctttcatgcccgtttgcttttctcagatcagccataggcgaaacaccgtcaaaggtaatatattctacccactcactcatttcctgtacagtgccgcttcccacattgccattcacataggtcttacagccaagctgactgcacagttcaaaaaattcatgagtcccgaagctgttgtcttccactacgccgccccagtgagtgttgatcatcttctttctgttttcttttgggccgattccatctttccagtgatattcatcggcaaaacagcctcccggccagcgaagcacgggcactttcatctctttcagcgcttccaccacatccgttctcatcccttttacattggggattggagaattttctcccacataaagcccttcgtaaatacatcttcccagatgctctgaaaaatgcccatagatttcgggattgatatgtccctgcatttttttctcgtttacatataactttgccatttatttgtcctcctgtttaaaataatgtacgccccaaatagtctcgttattgtctcctgctgccgtgaaacacatggtctggtttccggcctcttctttcatttcgatcatgacaccttcataattctgtccattgagttcaactgtcacataaggtgttcctttttccagggtaaaactacccaatgttccgcctttactgtccctgatgacaccgccttcttcaaagatgatactttcatacttatgtaccttcgagctgatatccgtaccatggtttacataatagtatgtacccaggatttctttctcttcatagccggattctttcaaagtctcacccgacgtattaaaaggtgccgccaccggccatccgtctttattgataaagatctgatgaacccttggttcatgggcttctgttccgtttttaaaacgctggtgatacacaacatacttcctgttgtcgtcatctgcaaaggcggagttgtgccccggtgccatataggtaaatcccaaactgggaaatgtataattccccatcatcttcagaccatatgaactgtggtccaccaccatgcccagttcctgtcctgctgtatctgtgtatggcccgtccggattttctgaacggaaaacccgcatctgatagccgccttttgcctgaagtgcaccataagatacaaagagataataatatttgcttgtctcgtcatacatgatatacggaccttcgatggaattatgaccgccgccaagcaggtgctttccataataggtatccacaccgttttctgcgtctgcttccggatgaatgggatatcctgtctcctcgtcgatttcaaggatgaatatccctcccgaccatgagccgtatgtcatccacatcttcccgtctgcatcatagaaaaccgttgggtcaatgcagttaggccactgcaggttatcataatctcctgctgtcagataatctgtaatccttccattcgggttaatttcctcgaaattaatggtatcccagttctgattggtaaatccggaatgaatcagtacgtcctggaaagtatacggtccatccggttcatctgctgtggcaaagcagatcgtagacttcttgtaggtagagctggtagaaaaatacattacatatttgcccatcttctcattaaaaatcacatccggcgcccagacagaatacccgcccgcatcattttttcccacaaaagaaaaagcctccatgggttcttcaaataagtcatcaaacagtttattattttcgtccacaccggaagcaaacatggaccactttaccaaatcatccgactttgccgcatccatatgggacccgaaaatataatatgtatcgcccgccttaagtatggacgggtcatggaccgatgccccggtggtatagcctttttgattctccttgatctcctccagagtcatctcctctccctggtgggctccacatccatataagacggtgcctataaccagcgcccccagtaatactgcctgtactcgtctcaaaaaataacctcctcttttttattaattactaaaatattttatatttatcaaaattatattgtaatatacattcatttgcaagccttttattatgtttttttgattttttcacagaatccacttgtgtactcgtcgttcatattgttttcttgtaaattattttactatatgctacaatactaaaaaagtgccggaggcaaaagcttccgccgtgagaggagttttgaaatatgaaaaaaatgaatatacttcccaccgctgactgcctatgccaggaaaaccaacagacagcctggctgcgcccttatacaatggattggaatactcccgaatctgacagcctgcatctggaatacagctacaataaatcagactggtatcaattaaatggcagcaatggtgtctggttccctgatttcggctccggacgtattgcatcccctgccctgtatctgctgaaagatcacagctttcttgttacagccggcgacgcagagtatgcagaccacaggcatcttgtcagaacagaggattttattcattacacgggagcctcctacacaggcagagacagggaaatttccgattcctatccagtgataaaaacaccatatcctgacggaagcctggaaatccccttatccgtattaaaaaacctccaggccgtatacggaaaacctgagcccgtactcctgcacgctgtggaaagtgttgatgtcactgtaaaagccggagaaacaccctgccttccgaaaaaaatcaccgtggaatataccaatggaatgcaggaagaacgaaatgtgatctgggacatgtctgccgcaaaagaagcaccaaaagactcccgttcctatgagatcaccggacatctggaagagacccggttccccaacccatttatttatcacagagctgatccttttatatacaagcatacagacggcatgtattattttactgcctcatatactgatatggagcacaatctggacggcaaataccagtatctctacatcatactgcgccgcagcgctacccttggggggctggcagacggttccggagcctatgaggaaaaaacagtttatgaacgcagtcccatagcagggggcacattgagccctcacatttgggctcctgaaatccactatattgatggaaaatggtacatttactacaccactaccatctctgatgaatcctcctggcgcatacgcccacactgcctggagtgcagtgacacagatccgtttaagggaaactgggaacaaaaaggccctgtagtcactgaggtcaaaggcgatattgccttcacagacttctctcttgaccatacacattttgaacatgaaggaaaacattattttctgtgggcacagaaaacaaataatatttctgacattttcattgcacagctctccaacccctggaccctgtgcactccggcagtccgcctttcccatccggaatacgcctgggaactgcatggtttccccgtggacgaaggtccgggtatcatcaaacacggcggcaggatattcgtcaccttctccggcagcggcacagattccctgtactgcgtgggcctgctttatgcagatgaaaaagcggatcttctggatgctgcctcctggaaaaagctgccctatcctgtcttccagagcagccgggccaccggccagttcggcctgggacacaacagctttaccagatcggatgacgatacggaggacctcatcatctatcacgggcgccaggaggagcgctacctggtggaggaggactatcagcccctgtacgacgcagggcgcaatgcttctgttggaaaaatatactgggatgaggacgggatgcccaacttctctgtgccgtcccagatgatcgtgcgcagggaagaagacctgcaggtaaccgccaggatcaccatccaataaattcacaaacaccattttgtcacgcccccggcctggcaaaatggtgtttttttatccccataaatactccgtcctctccccctgtcttcactgtaagtctgaaaaatccccttctttatctcttttgccttatcaattaccaaaacagccacaaattatattgacgttattttttataggtgatataatccacatataacatttgcaatatattaatttgcatataccaatcaggaggtgaactaaaaaacggtatcaatatcattgcagaaagaaaagacggaaaaattgcagcaataagccattacttatgatgcccaacagaccgggcagcagaaaggagaacatatgggggactcagatggagggaagaaacgaaacgggatcagcagatcgctgaaaagattttttggtgtaggggattttggtttttcctttatgaccaatattgagacctattattttacttattttctcacaaacattgcagaattttcacttccggttgtgaccatgatcacaaccatagccagcgtggtggacgcggctctgtcctggatatacggggttatcctggacaccttcaagcccatgaaatggggacgctaccgctcctggcttgtagtcatcccatggctggtgccatttctgtatgcgttccagttcatacgcgttggaagcggcaccgcggccgtggtgatcatcattatagccaccataacaagccatattgcgtggaacataccgttcgtagccaatatttccatgatcaacatggcttccaagactcctgaggaccgcatggccctgtcctcatcaagggctatctggcagtccctgggaagagtgttctactcctatgtaggcccggcagtggtctctgtcctggccggtatcgtaggagagaaaaattcttacggcgccacagcgttcgtatttgccgcgctgatggcagcaggttattttgcacattttaaaatgtttgagggctacgaggaaaccggtgcccaggaaattgaaagaatgcagcgggaacgcgctcagaggaaagcccgcggacgtcaggaaaaggaaagcggtcttctcaaatgtctcactaccaatccttaccttttaggcctgactgtggctgacctgacaaaatatatctacagttttgtcgccagcggcattgcagtctattatttcacctatgttgcgcacaacaaggatctgactgcaacctttatccttatctccagccttcttggagtcgctgcttcttatctttcaaaagcagccgccaaaaagttttctgccagaaacaccgtcatctacgcctatcttgccatggcagttgtgcttgtactgggattcctcttctatcgtcagccatgggcggttatccttctggtgagccttgcgcagttcttctgtaccatgacaaacgcatgcggacctgccctctatgcggactgtgccatttacagtgaatacaagaccgggaaaaacgccacggggctgatcatgggtctcagcaatattcctctgaagatcggtgtggtaagccggggtattttgatcagcgcctgtctcgccattgccggctttaaactggaaaccgtggaaaaagggatcacctccccgcagctcgaacgtgggatcagcatgggctttaccatcattcccgccattgcggtagctctgggcgcagtcattatgatcttcggattccgcctcacaagggccaagatagaaaaattctctgccgaactggaaaagcggaaataacccgcatataaaaaggaggaataatattatgttaactaaacgccaaaatctcatggaaaccatcagaggcggcagccctgaccgctttgtcaaccagtatgaggcattccgcctcattcagaatcctctgggcggacacaatcccaatcccaaatacggagagatgaatgtaaagaacgcctggggtatcacgcgctcctggcccaagggcacaccgggtgcttttcctgtacacacaccggaaaaggtggtgatcaaggacatctgccgctggagagactatgtacatgcgcccagtgtcaaattctctgacgcagagtgggagccttttatcaaacaggctgaggagacggaccggagtgagtattttgtcatgccttttgtggcccccggtctttttgagcagtgtcatcatctgggagagatccagacaacactcatcaatctctacgaggaaccggaagctatgcatgagctgatcgattacctcacagaatttgaactgcagcttgcagaggagatctgcacacacttaaaaccggacggcctgttccaccacgatgactggggcagccagacttccacttttatgtccccggccatgttcgaggaattctatctgccgggctataaaaagatttacgggtactacaaatcccacggtgtggaactgatcgtgcatcactcggattcctacgctgcaacctttgtgccctatatgatcgacatgggcgtagatatctggcagggagtcatgaccaccaaccgtatcccggaactgatcgaaaaatacggcggaaaaatatctttcatgggcggaatcgacagcgccaaagtagattacgaaggctggtccagaaacgtgatcgccagggaggtaaaaagagcctgcgatgaaaatggaaaatactatttcatccccaacgcatccatcggacttcccacaagtacctatgacggcgtgtatgacgtgatcactgaggagattgacaaatacagcaaagaggtatttggataacaccataaaacaaaaacttgtcggacagcgggtatttccctgtccggcaagttctcttttcttattatgcattcagcggatatttatctgtcagttcttttacaatagcctttgcctgctctttcttctcaggctctttcaccatgatcgcaatggcctctgcgatcttatccatatcctctgcgttcattcccctggatgtcacggccgctgttcccagacgcacaccacttgtcacaaacggagattccgggtcatttggaatggcatttttattgcaggtgatgtttgcctcatccaacaggttttccatggcttttccggtaactcccgtacctctcagatcaaccagcattaggtggttctctgtggtaccggatacgatgttgatgccgcgtttcagaagtccgtcacacagtgctttggcatttttcacaatgttctgctgatactctttatactccggctgcagtgcctcttttaagcagactgcctttgcagccaccacatgcatcagcggaccgccctggattcccgggaacacggccttattgaaattgaatttcttagcgatctcagcactgcacatgatcataccgccgcggggacctctcagagtcttatgggtggttgttgtcgtcacatgggcatatggaatcggacttgggtgtacacctgccgcaaccagacctgcgatatgcgcaatatctaccatcaggtaagcacctgcctcgtcggcgatctccctgaattttttgaaatcaatgatcctgcagtaagcgctggcaccagctacgatcagcttgggtttggattccaacgcgattttgcggacttcctcataatcaatcacaccctcatcgtttactccgtaaggcacaatattaaaatacgcgccggagaaatttgccgggcttccgtgtgaaaggtgtccgccgtgggccaggttcatgcccatcactgtatcaccgggcttcagcatggcaaagaagactgccatatttgcctgggcaccggaatggggctgtacattcacatattcacaatcaaacagttcttttgcacgttctacagcaagacgttccacttcatctacgcattcacagccgccgtagtaacgctttcccggatatccctccgcatatttgtttgtcagcgggcttcccatagcagccatgactgctttgctcacccagttttcagatgcgatcagctcgatatgggagttctgacgctctacctcatcattaatacacttcgctatttccggatctgttgcctgaatttcttccaatgaatacatgttttccaatcctcacctttcttataattaaccttagagtccgctgtgcggatactttaccgacattatctttcttatgaagatatttgttttccaccgaaagacatctgtcgtgtaaaaaaatgcccagagccggaatcgaaccagcgacacgaggattttcagtcctctgctctaccgactgagctatctgggcatacgtgaaaatacggcgatattgcaccgttttctcaaacaacactgcaatattatcatattcccttttatatttcaatagttttttttatttttttacattaatctggtaaaacattattacagctctgtctgtccatgctgttgcaaaattccgttgctgtccacagatctgttttaacagacccgtggacagacaacaggaaaacaagtgttttacacaacggtattccggatacatcctataccttcaatcccgcattccaccacatccccgggattcaggaatctgggcggtatcattcccattcccacacctgccggcgttcccatggcaataatggtacccggctttaatgtcatgcctgcggacagttccgcgatcacatgcgggatatcaaaaataaacatatccgtgctgctgttctgccgcagcacttcattaactctgctcttgatcgccagcttgggcggtctgggaacatcatcctctgtgacaataaacggtcccataggggtaaatccatcaagactcttgccaaaataccactgtttatgacgtgtctgcacatttctggcactcacatcattgataacggtatagccaaacacatagtcaaatgcgtcttccttctttacatcctttgcctctttgccgatgataacagccagctccgcctcataatccaggctgtccaccagtcccggataggagggtatgcagcctccgtcaggtgttgcctcattcacacgcttggaaaaatacactgcgtagggacgttcctgattaaactcctcttttttaaaacggctggattccactgcgtgatccctgaagttcagccccagacagataatatcctgtctcggatggggaattggggcgcaccggactacatcctcataacacaaaagcctcttgttcggcttctcacaggcatgctccaagatcgtcctctgttcccgggtcatattctggatcaaatcattcatatctctgaagtgaagccccagatcctcaatggggataaaacgatggaatgcaaaggaacacatcatacccagccgttctttatcatcacccttcagtttatatgtaagtaatttcatgttttttcctcctcatgcaaaacacccgtcaaagatttcagcacgttacaacataaaatttagttatacataatagtatcatagttttccggtgttttccactaaaatctcataaaattttatgttatttgcataaatatattctgttcacaggtcactatcccagtaggcattttgcacagcaaaatcccgagtcagcctctagaatactatgaacaataacataaatattattccttattccggcaattcctttttggagaattttgacgagagaataaccgacgataccgtgttaccgaattttcccagttcctttagaagtccctcgaactgtgctgtatccggaacaaacaccttcatggttgcgccatagacaccaatcgtgtgatagagttcaagtacatagggggaatcctcacagtatttggccagttttggccaactgctgcttgctatctccatgttgatgaatgctgccatccccttctggatccgccctctctttatgatagttctgtatccttcaatgataccctcttcctccaggcgccgtacccgctccgtcactgccggggaggtaagacctaccatgtttcccagctctttcatagatattctggcatttccctggagaatgttcagaatctttttgtccgtactgtccatacgacctgccgcctcctgtcaactgcagcaattcagacaagctgaactgtcactgccaattcactttgttcattataaatctttccccataccttgtccatcaattttccttgcgcaggacaatccttttaatattttaagaaaacccgtaaaaatactttaattataaaagccggatgccccatatacctttttcctcccatgttccctcaggcttatgactgctacaatatagtcagtaacaaaaaccactatctaaggaggccttttttatggaaaatataaacttacccatcacaggaatctgttcctttgccaaatatcccatctgtactgaccttgacactcttgacgctgacatcgcggttctcggtgtaccctatgaccagggagcagcctggtacggcggacagcgcctggctccccgggcggtccgcaacatctccactgcctacgcaagagcggaaacaggattctatgacccggaggaggacgcatatctcctggcagcaccgatcagggttgtggactgcggagatgcagatatgctgcacggagaccaggaatactgcttctcttccatagaagacagtgtgcgcaggatcctgaaacgcggcgccgcccctgctgtgatcgggggcgaccattccatttccatccctgtggcaagggcattaagcgaactgggtgaaaccatcaatatcgtgcagtttgatgctcatctggactttgccatgtcccgtggacctcagaaatacggaaacggcagtcctatccgcagaatgagtgagatgccacatataggcaatatcgttcagatcggcatgcggggcctgggcagcagttcccgtcaggactggaccgacgcccgtaacgcaaatactgtgatcaccgcaaaggattttcaccgtatgggcattcagaacgtgctggagcagattccttccggcaaaacttttatcacttttgatatagacgcctatgacatctcgctcatgcctgccacggctgccccttcacccggagggcttctctacgatgagacctgtgaactcctctcgggtatctgtgccaaagcagaggtgatcggattcgatctggtggaaacagcgccttcctatgacacccccgccaccaccggatgccgtctggctgcactgaccatgctgcacatcatgggacagatgacgaaaaaaacactggaataattctccttcattgattataatggttcaaaacgaacacattaatatacgattggaggaaatgcttatgcttcgttccagttattatcttcagcagcttcaggatctcctatatatcgcccctgttgtgctcattgctatcatgggccatgaatttgctcacggctgggtctctgaccggctgggcgatcccacaccccggatggacggcaggctgacactgaatcccctgaaacacctggatccatttggcaccctgtgtctgatcctctttagaatgggatgggcaaaacctgtgaggatcaacacccgctgttataaaaaccgaaagtccggcatcatcatggtttccctggcaggacctttcatgaactttatcctggcctttatatcccttcttctttacggggccgtgggaaaatacggaagtgccgcctctgcatctgtggctgtatttctccggctgttttactattcggcagttatgaacatcggcctgggtgtctttaacctgattcctatcccgcctctggacggctccaatgtactggctgaattgtggccgggagtatctgccttttaccagcgcatacgtccctaccgcacctggatacttgtcatcctgctggccagcggtgccctgagcaggcccctgggtatggccaatgcccatattctcaataccctatggggcatcgtaaaactgctgctgaatctcaatccatatatgccgcagacaggcctgtccatttaattatagaagaatcctgcccggaggaatttcatgtcttactcagacttctatgtcctgcaccgacacattccgggcacatcccttcttctccggaaacagatgcccgaaaatccatctcacaaaaggtccggcaaaaaatatctgccagcataaagccattggaaaattcagggcagttgtctgcatccacttagcgatcacctgcgaatccaaacctttgaagagaagcgtggctatgagactcatcaaaggacacatgatacacacagtcacagctgatacggcaaggatcacaactgtcatcctgtcttttcccgacgtcacaatgcgaaacgccagtttctttgccagcggccccgctatgaacatttccagcaaaaatcctgctgcccccatgattaccagttccccaaatgccatcacaaatacttcatttgtaagccctcctctgtccagtgaaatgttgtataccaccagggcataaaccatcaccaccaccatgatcaatgtaaaaataatgtcttgaaactttgtcttcggcataataaaatcctccttattctttaatcagtctccggcaataaaaaaaggcagcgggatctatgactcgtaactttcgctgcgatcatgtcatataatctcactaccattttcatctaataccgttatttattttactgctactctatggtaacagaatttatttctctgtgtaagcacttttttcaatttcagcactttaccttctgctgttccctgcaccggtcttacataggtcagaatgcctgaaatcattcctcttctgtcttccaattcctgactgcgtcaaactcgtccaggatttcctgctcaggcgccttggtacacaggctgaagatcacaatgcacagaacactgatcaaaaagcccacagccagggaatacaggcctgttgctgcgcccagtgtctttccctgcaccagcggcagataatcccacacaaggacagcagcgcctccggagacgatacccgctgcggcgcctgcaaaattcgtccttctccagaacagggacatgagcacaataggtccgaatgctgacccaagtcctgcccacgcgtttgacaccagccccataatactgttgtcaggattccacgcaatggcaaatgccagcagcgccacaactataactgtgatgcggcttatcttcagcactttatcttcgtcggcctccgggtgaagaatatctttatagatatcctttgatacagaggacgctgtcaccaaaagctgagagtccgcggtagacatgatcgccgcaagaataccgcacagaaacagtccacccacaaacggaaggcgcagatccccggtaaagattctggtgatcatttctataaatacgctctcagaagacacggtcccctccgttcctaagatcaccggatagaggtatgcacggcctatgataccgataaacaccgctgctccgagagacagcgccacccatacaatagcgatcaccctggatttgcgaagctcctgctgattcttcacggccataaaccttgtgaggatatgaggcataccgcagtacccgagaccccaggcgagctgggaaaaaatctccacaaatgtgtagggcctgtctccgtttctgatcaaactcagatatgaggcatgaccgcctgccaccccgctgacatccaggagactgcccacattgccgcctcccaccaggacgaaggcaatgacaggcaccagaagaagtcccaccagcatcagagtgccctgaataaaatctgtcacacagactgccatgaagccccccataaatgtatacgccaggataaccaccgcaccgatcgccaaagccacgtggtaatccactccaaacacagagttaaaaagttttccgcctgctgaaagcgctgacgctgtgtataccaggaaaaagatcacgatcacaatggaggaaaccagaagcagaatcctctttttatcccgaaaacggttttcaaaatatgccggcagtgtcaatgaattattcgccttgatcgtataccgcctcaatctggatgagatacacacccagttaaataccgttcccagaaacaggcccactgcgatccacgcctgccccgttcccagagcatataccgttcccggcagccccatcagcagccatccgctcatatcagacgcctgggcagacagcgctgccacccatccgctgagacctcttccgcccagaaagtagtcctcagaattattggtcttcttcatataaactgcaccgattataatcatcaaaaacagataggcggcgaatgcagtcagtatagccatcatatcactattactcatccctttatcctcctttttctatagttctattatcctgaattttcgcaatttgtcaaatagttcctgcaatttaaattataactggacagacctgctgaacagcccccaaaaacacaacaaaaaaagaagacactcttacatgccttctcgtcaattaaaaagagcgatagacgggactcgaacccgcgacctcaaccttggcaaggttgcgctccaccaactgagccactcgcgcataagagcgggtgatgggaatcgaacccacgtgatcagcttggaaggctggagttctaccattgaactacacccgcaggttattctgttgttgtgtgtctgtccttaagacgttatttatcatataataaattgttccaattgtcaagacattttttacaatttttttcaaggaaattttgccgttactattcacaggacttcgcctcttccgggactgtaaacagtaatatttgaacttcttttcaatctatgttatgctgtaaatacttatgtgtgctgaaaaatgcatttatacttttcagcacagtcattcggacaatcctttgtcctaaatcaaatgaagaggaagggtgttgattttgaaaatacaagaatccgcagaaaactatctggaaactattctcgtgatcgggaaaaggaaatcccatgtgcgctccattgatattgccaatgaactggacttctccaagcccagtgtcagcgttgccatgaaaaatctcagaatcaacggctatatcgaagttgactccgagggatttatcacacttacaccggaaggccggaaaatcgcagaaaaaatatatgaacgccaccagctcctctccggctggctgatacgcctgggcgttgaccccaaaacagcagccgaggatgcctgccgtatggaacatgtcataagcgccgagagttttgatgccatcaaaagacatactcacggtgtcaataagaaatagaaagcgttttatttgatatgaaaatattattggtaacagaacaattctgtctggcaaacaacggcatgacgatctccagtcagcgattcgcacggatcttaagagaacacgggcatgaggtccgtatgatggggtacagcagagaacctgcagatgcggacggagaatatgcctatgccatgaaaaagctcaccatccccatatttgacagcctgatcacctcccagggaatgatatttgcaaaagtgaacaggaaaaccattcgcgctgcacttatgtgggccgatctggtacacatcctctcgcctttcgccctttcccatgtaaccataaaaatggcccgtctctatggtgtgccctttacaggtgcctttcacgtgcagcctgagaatattacctcctccatccatctgagcagagctgatcttgtgaacgatgccatttatcactggttccatttttatatctaccgctactgccgtcatatccactgtcccagtaattttattgccggcgaactcagctcccgtggctatcactcacagctccatgtgatctccaacggcattgacccggattttgtataccgcaaatcccccaaagccaaagctctggagggaaaatttgtggtgctcatggttggacgtctctccattgagaaacggcaggatgtactgataaaagctgtgtcccgttcccggtacgcagatcagatccagctcgtcctggcaggtaaaggccccagaaaggacgccctgctgaagctggcagaaaaagaacatctggccaatcccatacagatacacttttttccgaaaaagcatctgctggagctgatttccatgagtgatctgtacgtacatgccgcggacgtggagatagaagccatgtcctgcatggaagcatttgccggcggtctggtgcctgtcatcgccaacagccgcaaatccgccacaccacagtttgcgctggatgaacgaagcctcttcagagcaggtgacagcgatgacctggctgctaagattgactactggatcgagcatgagcatgagcggaagatcatggagcacagatacagtgagcttggcaaaaaatatgctcttgaaaactgcgtccgccaggcagaggaaatgtttcaacaggagatggaggagcataaaggaaaaaggaggcgtttcatttgccggaaaaaaaagaccggatcaaacaagatcctgaaagaggatgagcatgttcttcacatgtggcagcctttttcttttgaagtaaaaaaaggctatgattaccggcgcaccaatcccatctcccgccttacctcctccctcctaaaaacggtcgcggtgcctgtcctttcaatatttgaccgcattgtgctgggttcccgcattgacggctggaaaaacctgcgccgtcttaaaaataccggtgcagtcactgtctgcaatcatgttcatgtactggactgcactttagtggagcaggcgctctggaaagagcgcacctatttcatcaccctggcatccaactttaaaatccctcttgtacggcacttgatccgtattctgggaggtgtccccctgccgacagatgtacagaccactgcggaaatgttttcggagatgggaaaagcgctgaaaaaaggtgcctgtgtacagatatatccggagggaatccttctcccttactgccgggggctccgtcctttccgaagaggcgctttttatctggcagaggaaaaccaggttcctgtacttcccatggtgataaccttccacagtcccacaggcatccgccggatttacaaacgaaagccttgtctgcatctgcacattcttccgccgctctggcctgaccctgccctgcccaaacggcagcagataaaggaccttcaggagcgctgtttttattccatgcataaaaagatcacggaatcccgctgaatcacctgcggtttcccgtgatctttttattatgccagacctttttcctccagccaatctgccagaatatgttttccggctttgatcttccttgcacggagctgaaactctatcagcgtaagcccggtaaataccacacaaagaatgatcataaatatcactgcgttctgaatgctctctcctcctgagatcgtacttctgaaagcttccaccgagtatgtgaacggcacccatttatgaagatacggcacaaaggagcctgaaatctccagcggataagtacccacagacccggcaagctggactaccataaataccagcatcaggaagcttcccactttgccgataaaattagtaaagaaatacatcactgacataaatgccacactggccagacacgcaaatcccatggtcctacccatctctatgggatcaaacccgtcaaatacatgaagaagcagtaccatggcaacagcctgcaggactgctatggcataaagtacagatgccttgctgagccaccaggaaaatcctgattttaatttccctttgtatttcgtcagcgggtacatcaggctgaatgcaatacatcccacccataatcccacactcatcatatagggcgccatagcatgcccgttattctccactgtggttatcatagtttcatttgtctcaaccggagcggcaaacatttccactgtgttatctgtagtctttgtatttttcacctgttctgccccatccagaaggctggtactgagcgtatgggaaccgtcagcagcctggagaatgccgtcccccagctctgcgcttccatctctgagctgaccggcccccttctggatctgccctgctccttcacttaactgagaagctccatccagcagagtactgttatttgccgtaagctcaccggttcctgaaaccagagaaccggtcccatccttcaactgcgcggctccgtcatagagttgaccgcttcccgcaagaagcgcttttgctccgtcatccagacgttttgctccgtccgacagggttcctgcaccgtcatccaggctgccggctccctggtcaagctgaccgacgccctctgccagttccggcaccttgccctgcagcgttttggcaccttcctttacccggcctgcaccgtcacttacaccggtgatgccatccagaagactgtctgcgccgttcaggagcggcttcattgcttctgtcctgaattgtccgcctgctgctgccgcctgctctattcctgccttcaaaaacggagttttctgactcagtccatctgttcccgcttccagcttttcagcacctgcctttgcctgagtggccccggaatgcagtgcctcagctcctgtctccagtgctgccatcttctctgcagccgcttttacgcctccggtgtatgcagccgttttctccgcaagcagttcactgctgtcacgcagtcggcctaccgcattcactacctgttccatcacctgcgcatccgcggcagatggctggaggttctctgcaccggacatgatctgcccgtcaacactgtcaagtccttgaactgccgcgtctgccgccgccgagacagattccccggcttctctcacagcactgctgctctctctgagctgagccgccgcactttccaggcggctgttgccctcatatacggcgttttcattttcctttgccacagctatggcctggtcagcaattgctgctgcctggcctatatcaccagaggccacagcttcctcaagggcagcctccagtccatcagcagataccggatccacactgccaagggcatccacagaggcctccagatccccggcttttccctgcagtccatctctcaccccatacagtgtttccaaagccgcctttgcatctgatacatccacttttgactgtgcagcagccgcttcccctgaattctgtgcactgcctcccccttctttgcctgttgtcagcatagtgtaaagctggtccagcccctggttcagtgcggatacaccatctgccaactgctgggaattggctccgtcttccccgttgacagtctccataccggccttcagcattcctattcctgtcttcagatctccgcttccggcctctaacacttctgtcccctcaacaagagcccctgcgcctttatggagctgttctgccgcatccggcagtgtctctgtactctgacgaagtgtttccaaccctccgcaaagctctgccatggctgcatctgcattggatacccccactttcagggacgtacctcctgtttgcaactgcgtcgctccccctgccagtgcccctgtaccctgcacaagctgatccactccgcctctcagcgcaggtatctgtccatccagttttgaaagccccgcatgcagtgttcccgctccgctcttcagttcctctgctcccgacaccaacgtaccggtaccgtcagaaagctcatttacacctgataccgctgccgccgcaccgtccttcagctcagccgcaccggaatccaactggccggcgccatccttgactgtactcacgccgtccacataggctttcagccccacacgcagggtgtcacttccttcccgaaaggttagggaactgtccgccaaggtctcaagattatctgtaatggtccggttcccgtctgaaatcttatttacaccatccttcagatccctggagccatcagcagcctcctgcatcccgtcccccacctcagcgatctggtcaaacacagcctgggtataagtctttgtcacttcctccgccacactgtttttcaccttctccatagccgtctcactcatcttggacgcgatataattggtacccggattcgtctgatacgcaagctccatcttctcaggcttctcatccatcaccgtagcagcatttgcggaaaaatcctctgggatcgtgatcaccatataataggttccgttcctgagccctctctctgctgtctctgcatccacaaaattaaagcaaagcgattcttcttctctgagcttatctgtcagctcctcccccacattcaattccctgtcattatatgaaaccgctttgtcttcattcactaccgccaccggcagcttatccaaatttccataggggtcccacattgaccccaaaaaaagtgtagtataaatcgttggaatcaaaacaatagccacaacaaccactaaaagaagcttattgtggaccagtcccttccattcctttctcagcaaatcacattcccctttctgttaccaattttatcagcacgccatccacaccctttttaccattctatgccccgcctttgtttttgcttgactaaaattctattaatagataccgtgttgatttttaaggtaatctgtattatactaaaaccacttgatcctcacaaccatcaattccccctcaccctatccattactagacatttctgcatatatttgttgcattttatacttttttaacaattgtcttcccacttgaaacagttaggaaaggaggctcccctatgcccaaaaaaccagaccgccgtatccgtaaaacaaaatcccagctccgcgccggtctctcaaaactcatgcagcacaaaagcatcaaagagatcacagtaaaagaactggtagaagaggtcgacatcaaccgctccaccttttacctccactatactgacatctacaacatgctggaaaccatagaaaacgaactccaggaagaaatactgaagatcatccaggaacatcctgtcagccccttcaacgaagacagtttcccttttatagaagacatcttcctgaccctctgggaaaacaaagacatctgcagcgctcttttaggccccaacggtgacatgtcctttgtcagccgcatagagagcatcatatccgaacacagcctgaaagtcctgaaggccaccttcccggaaaatatggacagcctgaaatactcctattccttctgtctgacgggatgtatcggcctgataaaaacctggctggattccgataccggtgaatccccccagcacatggctgatctgaccttccgtcttatcatgaacgcgctaaaagacatttatccgtaaccgttcgtcttcttctgtcacgccggctctaacctttattcaaagccttactctgcccgccgactgcggttttctaccggtttcggaaaaaaaaacggcccaccgtcttctatatctccgccccatgcagtatgatctgcataacgcattgatatagaagacggcgggccaagcctgcctagtgcatctctgcatgctttccgaaccaatcgtccctgagtgccgcgtaaagctccgcatcggtggcatccacatatggcttcacataaaagatacccgccactccacaggtcagtgtacctatcagaaaccagccgataaaagaaagatccagaacaaaggcttcccacttctgtccatacatcatttccttgctgatccgcagtgcctccctgtaatggatatccggctgctccgccagaatataagggaccatgcggtaggcatagctcatcacgattcccgggatcacaaatagcaaagtccacagagcaacaaacagattcttcataaacataaccaacactgaattcccgtaaaacccactctgaaagccaaacagcagcttggagactggtgcattataatcacggttctccacataaaatctacaggctcccaccagcagcatctgaaagataaaaacatcaagaaggatcacagccagggaaacagcccctgcggtaaatgcacttcctccccagttgaaaaatgaatgactccagtccagcttcaagtgaagtcccggaatctcaagaaacgggcctcccgagccgtcaccgttatagttacgcccgtactttgtagccacaagagctgatatcaaggataccaatactgccggcccgtaatttttcaggaaatttgctttgccgctcatcttcagatcaattctgttccacataatctcatccccattccccggaaccatagaacctgtttccggataattctcactgttccatattaccatattttcatggagaatgatacttctttactgcattttctacctgaacaatatcattgatcccttctgttgcccccagcctctgcactgccagtccgccgcagacgttggcatatgccgctgctgtccgcagatccatgtcctgtgacagggcgtacacaaatcctgccgcaaaactgtcaccggcgcctgtggtatccacacaccggatgctggaaacagccggactctcaaagaacatttccctgtttttcacaaaacatcccttattcccacatttgatcaccacattccccacaccgcagtccaaaaacgcgtctgcgatttcatgcagttccctcttctcggtaaccagcacggcttcctcataattcgggaaaagataatctacacaggccagcgcctcccggatatccttcactgtctcttcattctttctcttggtcatatcagcacagaccaatattccctgttcctttgccctggaaaacagccgggcagtctccctgccgccaagctttggaaaaacaaagatactggcaaaacacaggatttttaccccctgcagataatccccctccagatgctccgcagaaaggctgcgcagcgtgccatgaggattcgtcagaaaactccgttctcctccctttttcaccagaaccacattgatccctgtatccacgccgggttctgtcctggtatgatcaagtccgattccccatttacggcagtgtgcccggataagctctgaggcggggtcgctgcccagcacagtcagaagctggacactttcccctaattttgccagaatagtggcttcgttcagggcatcccctcctgtcctcatggtgatagcatcagccggacttgaaccggtctcaaaaacacgctcatccaccggttctgccagcacatccagtatggctgcccccacaactaaaattttcccatccatatcttctcccccttccactttgctctttctgaggataccccatttttcactgctttttctgcaagctctcctgttttcactgcttatcctgcggtctcttgtttcctctactcacaatatgcaggcaccaagccctcgtattttgttacttcagtgtattgtcatcccggaactttgccaacaacgctttaaactcctgtctgtctctgataaaatcaaattcttccagattttccagatcctccaataaccccgtgcgcatacgtttaaacaattccttctgctgctcctggtttcccttctgttcgtccaggctgtgatagagcctgctctcccccagcttccacggctttcccatagcgtccagcaccttctccagcatttccagcgttctgtctgcatcttttcgtgcagccgcagtttcataatctgccatatactttccgtactcccacagatccagcagttccactacatccctgcatttccccgcatagtattccatatcctcccggctgccctgttccttatggatctccataagtgtgatcagacagttctgcacatcgcctgcagcctggagcagcttttgctgtgccagctttactgcctcttccgttttcccctgtctcctgtaaaggagtgtgagcattggcctcttatccactcccggatccggtatctgcgtcagcagttcctctgccctgctgtagttctctttctgaatgtaatcggcaaccagcatattaagggcactgcctcttatctcccagtccgtctcactgttcatggcagtcctttcaaataaacccaggatttcctcctcatatgccgccttatccttttcctccacgggaaacatgagcatggcccccttcagaaaaccggcaaggttatagatcagcttgctgctgtttggatactcgctgatcttcttcatagccagctcatacccttctttatatcctctctctttaagcactgcgtaaacttctccgcagaaatgattgatctcctcacccgtaagctcctcctcaaaggacagcagggtattcagatccaccttcagaagccttgccagaggcggcagcaaggtgatatcaggataactcactcccttttcccatttgttgacagccggcgctgatatccccagatactctgcagcctgttcctgggtgagtttcagttcttttcttcttgttctgataatctcatttattttcatcatattgtcctccgttatacacacggacagccggcgccagctcccgctctttacaatagatattataacagatacccattcccggcactattgattcctttttaatttttgatcataaattttaactgctgctcatattacaaatcccggcggcagcaaagtcataattttaccattgttgaaactgtccaagcgtgctataatcaaaattgcaggatacctgcacaaaatagtccaatttaaggaggttattactatgttagacaaaaaagtatctgaactgctgaacacgcagattaacaaagaattctactccgcctatctatatctggattttgccaattactataaagagcagggacttgacggttttgccaactggtacaatgtacaggctcaggaagaacgtgatcatgccgtgctcttcatccagtaccttcagaataacagcgaaaaaattacactggaatccatagacaagccggacaaggtatttgacgcctttgaccagcccctgcatgccagcctggagcacgagcattatgtgaccggcctgattcacaatatttacgacgccgcatacaccgtaaaagacttccgtaccatgcagtttctggactggtttgtaaaagaacagggtgaggaagaaaaaaacgcagaggatcttatccgcaaattcgagcttttcggacatgattccaagagcctttatatgctggattcggagctggcagcacgggtatacgctgccccttccctggtgctttgatatgagtggggaaaaatatctgtgtccctgctataaggtcacaaaaaaggacatcaaagaagccatcaaagacggagccacttctttcaaagaagtgcggaaaatgaccaaagccgggaaaggctgcggccactgtgagtgtaaggtaaaaaaatatgccaaaaagcagttaaagaaacacgcgtcctgaattaaggcgcaaaaatgcctgccggatcaagactctgcgtctgatccgtcaggcatttttttaccatattccaagtattctctgcatgaccagactcacacatgtaatcccggcccagcagcaggcccccataaaaataggcttcccgcctgttttaatgagcttcaccacattggtgttcagcccgatggctcccattgccatgacaatgaagaacttgctcagtgtcttcagaggattgaagattcccgccggaacgcccaggttcacagcgatggtggtgatcacagaagcccccacaaaatacaggataaagaagggaaatatttttctgaactcaacgttatttccttcctcctcttccagattctttgcccgtacaatggcaagtacaagggtgatgggaatgatggccaaagtcctggtcagcttcacggtcacagctttgtcaagtgtggcggcgcccagatcgtaaagggaatcccaggtggatgcagcggcagtcacagatgatgtatcattgacagcagtccccgcaaaaattccaaaggcctccccgctgtgtgtgtcaaatccgatcagagcgccaaaagcaggaaacagaattgccgccaaaatgttgaacaaaaagataacagagatggcctgggccacttcctcgtcatctgcgtcaatgacaggtgccgtagctgctatggctgaaccgccgcagatggaagaaccaacccctactaaagtggagatttttcccggaatccgcatcacccggtgaagcacataggcgatgaccagtgatgtggtgatggttgcaaggataataggcagggactgttttcctgtctgcagaataaccgacaggttcagcccgaatcccaaaaggatcaccgcatactgcagaaccttttttgatgtaaatgtaatgccgggctgcagatttgtcttatccttcagaatgagagtgactgccattcccagaagaatggcaaaaaccggtccgccaatgaccggcagtgcctttcccaaaaaccagctcggcagtgcaatggccaggcagagcagaaggcctttccaattttttttcataaaatccatagttcttttccccttttctaaattactgttactggtatatcttaccacgcatttataataaagaaaaattatttatatttatttttccataaaaatattttataatataatcaacactgactacaaaatattccacaatataatccgtaccggccacatgatattctataaataatctgtacccgccacggtaacaggattacggtcatatacccgcaatacaaagatttcaggaggacaaaaatatgcaggatttccgcatggaaacgtttttaaccgtatgtgaggaattgaactatacacgtgctgcccataaactgggactgacacagcctgccgtctcacagcacattcattttctggaggagtgttataatactcgtcttttcactgtgcaggggcggaaattatacctgacagaggcaggaaagctccttcacgcctctgcccagaccatgaaaaatgatgaaacccatctccgccgcagactcagggatgtacagcagccaaaaaaagaataccacttcggcgcaaccctgaccgttgcggaatacatccttcccgaaaaaataaaaaacatcctgagggaagaccctgactgccgtatgaagatcacagtccagaatacaagggaactgcttcgccagattgacactggggaaatagactttgccgtggtggagggttccttccccaaggaagaatatgacttccttccctacagcaaagaaccctacatcgccgtatgtgcccgggactttccccttcccaagtgtccctgcattctggaagacctgctcccatacaccctgatcacccgtgaaaaaggttccggcaccagagatatcctggaatccatacttgcccagcagaatctcaggcttgccgactttgcccgggtaatagagtacggaagcatcggcgccatcaaacggctgaccgctgcaggatgcggtattacatttatgtacaaaaaagccgcggaacacgagctccgcagccaaaaattaaaagagatcagattgcaggaattccatctgatgcacggacttaactttgtcttccgaaaagatacgatttttcgggaagaatattcaaaattatattccctcctgaaatagaagacacgtctatgccgcgtccacagattccattctctgtgaaagccgttctattttacagcagaccttctcaaaaacaaagtcaaacacaagaccatatacaactccgaacagattgtttgccagcctcagcaccatggacccggtcataccgaacattcccatagccatggcaagtgctccgaaggaattaaagactgtctgccacagataggtggctgaaaatcccacaccgatacccccaagtattccgataaacccgtagaagctctcaggaaacactgcacagagtccaaaaaacagggcacagccgattatatttccggggaaacggtgtttacacctgtttatcaaatccttccgaaagggctgcataacagacatcatggcaaatcctgcccacataattctgggaaggtgcataagctgtgcaaaaaacatgccggatgagataccgagagccatcctaagctgccactttgttctggccgaggaaaatgcaaattcccgcagcagatcgcccagccctctcttatacgaaatcttcctgtggtttctgtaaaagacaaacgctgttaaaagcgcgccaaaagccagcgcaaggacacgcatgaaatattcccggcccgacacatcattcccctggagaagcagatatcccagaacccaggtggcgtgatttgacataatgatattatggcatcccagggtaaggagcaggagcaaaaagacaaggttcagaaataacgcccatcccggagataccatattcgtcacttttggccccacagccagaaccccaaataaaatgacgatcactgcactgccgtgggaagctttgatccccagatccgcggacctgaaaaccatcactgtaagcagcaccaccacaccggcaacactgttcttctctccgaatatctttgtatatgccgtgacaaaagccatacagaaggccagtgtcagaaacactttaaaaatatagatgaaaatatgtcttctcttttccctcttgtctttactgttcttgatcagcgccttggaaccggcctgattcaactgtaattcctgataaatactcaaatgatcaactccctgaatgacaaatttccgttactgttttgtttccccgtattccccggcctgatggtttaccagacgtatcagctccataagacggctgaaagtctcctctcctgccctgcgcctcatggaatacaggggttccagataatacgtgtaagtgcgctccagctcttcccgccctttcccggtgatacatagataataactgcggtggtctgctgcacacatctctttctccagaaattcctttctgcagaggctttccaccagccggctgaccaccggcttgctgattcccatacccgtacagagcatatgggatgttagcttttcctttgagagcgctaccctggagagcagatccagttcctgtgaggaggatatcccgcctttttttgctctccttacatgcagactgcagaaaagcctgatatcctgcatccgctccatcatttctaaccaatcgtattccattgtccctctcccgcaaatggatctgcaaagttaccgtgaacgactgctctgcaagtacctgctgtcgtaccaattcgatccatttcgtttcattacaccttgtctatttagtttactttatcaactatttagacatactactccaattagtttattttgtcaactatttccataatattttttaaagggtcacctgcatatccttaaactcttttggtgatatcccatactctttcttgaatgcccggtaaaaactggagtaatccccgaatccaaacattggatacacctcgctgatccccacatcccccagtatggcgtccttacaggcagccaggcgtttctttgtaatatactgatggatggacagtcccgtgctgtctttaaacacatgggcgatatgatatttgctcacataaaaatgcttggcaagactttccaaggacagatccccgtccagattttcttctatatgatcagccagcccctgatacaggttcatctcctccctctcactctttggataattctgttcatggacaactctgttcagatgaagaatcaaatcactgacacacagggatatctttgcctctctgccgaaccttttggagcgcatttcgtcaatcaggccgaagacctttgagcgaatggtattgaacgtcaccacatctgtgtgaaaaatatagttcttggtcaccttcacatgctgcatcagataggcataatccgacgatgtctccataagactgttgcagtattcctctgtgatccagaacacaaaacgccggtagggaacccgctggtccctgatcactgcatgatgccgctccttcggcggtatgagtacaatatccccgggtctcatagcgtgatcttttcctcctatcaccatgttcacatttccctccaaaaaaaggtagaactcataataatcatgcgcatggtcctttacctgggacaaataaaaatcactgtaataatagatttcaaaatcctttgatagcatatactgcctggtactgaacgctgtctgcagattctttttcatactcgtcacctccgtcatatctaaatggatcattttttacagcttatcacgaaaccgcaacttttgcaatgtaaacaacaaatcagtcaattggctttttcctcacaataattataataatagatatcaagtaaatgaatcccaagcggaaaagagaaaggatacaaaaagctatggaaatgacattaagatggtatggttccaaatttgacacagttactctgaaacagattcgccagattcccggtgtgacaggggttatcaccaccctttacgacacacagccgggcgaagtatggagcagagagcgcatcgctgccctgaaagaagaggttgctgcatcaggacttcacatttccggtatcgagagcgtcaacatccatgacgccatcaagacaggttctcccgaaagagacatgtacattgacaactatatcgagactctggaaaacctgggaaaagaagacattcatctggtatgctacaacttcatgcctgtctttgactggaccagaacagagctggcacgtgtaagaccggacggctccacagttcttgcctacacacaggaagctgtcgatgcccttgacccagaaaacatgtttgaatccatcgcaggcgataccaacggtaccatcatgccgggctgggagccggaacgtatggctaagatcaaagagctgttcgacatgtacaaagacattgacgatgaaaaattgtttgaaaacctgaaatacttcctggagcgcatcatgcctgtctgcaacaaatacgacatcaatatggcgattcatcccgacgatcccgcatggagcgtattcggccttccgcgtatcatcatcaacaaagccaacatcctccgcatgatggcaatggtggatgacccgcacaacggcgttaccttctgctccggttcctatggcaccaatctggaaaatgatctgccggatatgatccgttccttaaaaggcagaatccattttgcccatgtgcgcaacctgaaattcaactcccccacagattttgaggaggcagctcatctttccacagacggaacctttgacatgtatgaaatcatgaaagcgctgtatgacatcggatttgaaggccctgtccgcccggaccacggccgtatgatctgggatgaagtggcaatgccgggttacggcctctacgacagagcacttggcgctacttatttaaatggactctgggaagcaatcgtgaaaggagcaagatagtcatgcaggtaaatgaacagggattaaaaaataaagaacagtgggaaagcaaaggctatgaccttcccaaatttgacagagcagccgtgaccgagaagacaaaagaaaatccattctgggttcacttcggcgccggcaatattttccgtgctttccaggcaaatgtagtgcagaaccttttaaatgacggcgttctggaccgtggtctggtcgttgccgaaggatttgactatgagatcgtagaaaaaatgaaccgtccccatgacggctacagtatcctggtgaccttaaaagcaaatggttctgtggagaaaaccgttgtaggcagcgttgtggaatctctcaccgttgactctgacaacgacgctgacttcaatcgtctgcgtgaaattttcaaaaaggattccctgcagatggccagcttcaccatcacagaaaaaggctacagccttgtgaacggcaaaggtgaaatgctcccctctgttgtagccgacatggaaaaaggcccggaaaaacctgagagctacatcggcaaagttgtaagccttctgtacaccagatttcaggcaggtgaaaaacccatcgccatggtgagcatggacaactgctcccataacggaagcaagcttcacgacgcagtctatgcatttgcgaaaaaatggtccgaaacaggcctgacagataaatcctttgcagactatattgaaaatcctgcaaaagtttccttcccttggtccatgatcgacaagatcaccccaagaccggatccgtccgtagaagaaatcctgaaaaaagacggcgtggaagaattagagccggttgtaacctccaaaaacacctatgtggctcctttcgtaaacgctgaggaatgccagtaccttgttatcgaggacgcattccctaacggaagacctgagcttgaaaaaggcggtcttatcttcacaacccgcgaaactgtggacaaagtggaaaagatgaaagtctgcacctgtttaaatcctctgcacactgcccttgccgtatttggctgcattctgggctatgacctgatctccaaagagatgaaggatgagaccctgaaaaagcttgtggaaggcatcggatatgtggaaggcctgccggttgttatcaaccccggcattctggacccaaaagagttcattgacaccgtattaggcgttcgtatcccgaacccattcatgccggatacaccccagcgtatcgctaccgatacttctcagaagctggcgatccgtttcggtgaaaccatcaaggcatatcaggcctctcctgagctgaaggtatctgacctgaaactgatccctcttgtatttgcgggatggctgcgctacctgatgggtgtggatgacaacggcaatacctttgaattaagccctgatccgctgcttgacacagtgcgcccatacgttgcagacgtaaaactgggccaggctgtggacgcagagaagctgttaaagccggttctggaaaatgaaaagatattcggtgtaaacctctacgaagcaggtatggcagacactgtatgcagctacttctcacagatgacagccggtacaggcgcagtccgcagtacactggaaaaatacgtttaaaatgatccatcccttttgataccctttggggctgcacgaaacctccgctcgtgtggccccttttctctctgtttttttctgatcaccttgcaaaaagacggcaccgtatggctcaaaccatacagtgccgtctttcttacatttctaatatacttctgccccaaaaggcatcagtgccagcttggctattttaaaatgctgcatcccaaagggaattcccacaatggtgatacagagcacaaagccgatcaccagggattccagtgccagagggattcctgtcactatcatccagatgacattgagaagcagagagcctgctcctccaccgtactgtacttcttttccaaaagggaaaaaagccagcgacgcaaatttaaaacactgcatccccacaggaatccccacgatcgtcacacaccataaaagccctgccagacaccagctcaggccgctgatgcagccgccaaatacaaaccaaagcaaattacccagacatcccatatgaacacctcctgttccagtttattcatttaacaagtctctcagttctccaagaatcactctcacccgcataattgcgtcatccacctgttctctggcatcgttgatctttctctgtaccagataatcagctacaagcccgtcaaaaaagaagtcagcaaacgtaagaaaggaactgatatccatccgcagatcaaggggaacctgaacatccctaagctccctctggaatacaagcaattgtctctttgcctcttccatataacctgtggcgtctgacatttttgaatgctttacccagtctgtaaaaaaaccgcctcccagcatatcgaaaattccccagttctttgctccctgaagcttttctctggcattctccagactgtacagggctttttccccagctgctgccgcttcctcaatttctcttcttctcatttcgtctctcatctttcttttcctccattttctcagccagcttttctgcggcggatatctggaaggtgtactgagaatagatggaactaaaaaaagacctctatcatgacatccgccacaataaaagtcttgctatctcatttgatacggacacctctcggtatcggttgacgatttcaaacccgttcatctctgaacgttcagctactccctttcgattgcttggataaaatatagcacagaggagatgaattgtcaatatattaacgcaaaaatcccaagctgccgaactcttctcatctccgtttactactccctgctcactgtcggctgttcactactcaacattcactgtccgctgttcactactcaccgtccacagtcccggaatctgtaccgggattccctgtcttctggtattgcttttcaaactccggccttgaaagaggtttgttgaaatagtatccctgaatataaaagcactccaggttcttaaggatttccaactgttctctgttctctacgccctccgcaaccacttccatacacaattcctggcagagcgtcaatatattcttcacgataatacgggctttttcatttgtgaggagattatttaccaaccctttgtccagtttcaaatgattgaagcgaatcgctgagagaaaagacaaattgctgtattttgccccgaaatcatccagtgcgatgttgtatcctgcctgacagatctgttttcctatctgtgccacagtattgcgctccacttctcccatactctctgtgatctctatctccacataccgcttgtccacaccataacggaagatgatctcctccattctctctatgagctgttcttccagaagtgttgccctggaaaaattaagggaaacaggaatcagttctacccctcttctctcccactctttcaggattttgcatacttcctcaaagacaaagaagtctatgtaatggatcaggccggctgtctccaggtaagggatgaatttccccggcggtacaatgcctttcttcgggtcctgatacctcaccagtgcctccgcgccgcagagtgtgttgttatatgtatcaatcttaggctgcaggtaaactgtaaatcttcctgcagagatctcttttaacaattccttcaatacccctgcgcttctgtggacttccgcaaaaggatgctcattataatactcctgttttgctatcattctgcgctcatccgcactggcgataaggaaatccaggctgatgtccgtatctgaccaggcacttcccacagaaacactggctgcctcacgcatcctctccctcatcttcttcaaccgcttctcaaaagcgtcatgggaaatattctcactcaccagtaaaaattcatctccggtaaaacgatagacccttgccgcggggaattcctcctgcataatatccgcagtaaactgaatcacattgtcgccgtaggcgtttccgtaaatcctgttgatatccttcaaaccattgatgtctacggagacaatccccagtgaaatcaggctttcctccctgatagcagagcagaactccttataactgttccggttcagcactcctgtcagtccatcgtggtgcatgagaaactcctgctcttcctgtaatctgcgctttgtgagttcatttgccacaaaatactgtattgtggtgagaatagtggtatgctccgtattccttttggggttgtcgatctccatgtatcccatccgtttttccccgtcctccaggcacactaaatagcaggagtcaatgccaaggctcttcatatttttataaaggccgctgcgcttctctttccactgttctatatcctgtataaattgaagcctgcctaattcctcccatttccatccgccgggacttccgggatataagtaaggactgccgctgacaccggcggaaaacatatcctcttttttccactcatacacttcccggatttggccgctttccggctcacactcgatcacatatgccctgtcccctccataataggaggccagcgatcccagcacgttttccagtgcatgtccgaagtcagctgcactggtaagcgcgaacatgccctgcagcaataccgtttctccagcgctgccaagctctgtctgtgccgtattccgtaacgtgtccggaaccccaggattccccggctcatatttttttaggtgatcgctgtagacgaagacaccactcctgcccatggatatacctgtttccagagcagctctggccatctgatacagaccctggaaaatatgctctggacagttgtcaaaaataataccacaggatacattgaccggatggctgatattcggaaacatatagggaagggaaattgtttttatgacatcctctgcacactgccgcacgaactctgccctgggattgttatacaaaaagactacaaactcatccccgtaaaacctgccgataatggcatcctcaataaacctcaatttaagctggttgctgatttccttcagcacatcatccgctgccacataaccaatttcatgaaccagttttgtaaaaaagtccacgttaaataccagcagggcataagcctgcctcctgccctggtttttcagcagcgcatcccctatcatctgtatggcggtctccttgttgtagacaccggtctgtacatcatactccgcacggaacttcagggccagctccagatttttcttctcgttgatatcctccagtgtaccatagacatatagatcgccgttctgcacatcccgcaccagacgtgccacagcattgacccaggacagtcttccgctcctgtctttcctgcggtactcaaagttaatgactgtactgccctctttatacgctctgcacagggcatctctgctcatcatcttctgcagacgcagtttgtcctcctcattggccatactttcattgtgaagcaccatcaattcctcataagtcattcccggaggatattccatgcgcacctggccctccacgtactccacacaattctggtcaagatcacagcggaaactggcgatcacacctccgtcgtaggtgagcctgagctgcatttcctgctggtagaccatctcccaccaccagtagcttctgtccgcggaacgtgtgagaatatctgcctgtacatgactctgcccattctggagccggctgtataaatccagcaggtcctgtctgctcctgggatgtatatacccattctccaacagcgcttccggtgcatgttccaactgccggaatccgtgactctcctgtgcgccctccgtcagaaacagcgtgcgggtcctcatatcatattcccatacattgatatgggcttctttcagcgctgcccggtaaaccatctccttgtgggccagctccctctccagaggattctcggtctgcgtatatccccttggaagtatggcctgcgcctcacgggccactgcctgttcctccggccggttcttccaggccccgtatatacagtattggcccttgccgtttttctttgcccggtacatggctgcatccgctttggcaaacagggacataaaatccgtgccatgctccggataaaagctgacaccaatgctgcagccgatactacaggtgttctcgccattggtgtaatggtcaaatatattccgtatggcattgacctttgcttcaataacgctgttcttctgaatattggtcatgaagaccacaaattcatcaccgccaatgcgtgccacaatatcctcatgcctgaatattccccgaaggctgcccgcagtctcgttgagaaccttgtcaccgaacagatggccataggtatcattgatatgcttaaaattgtccacatcgatcagcagcatggctgccggatcatgtccctgctgcatatactgctctgccctcacctcgcattcccgccggttcagaagaccggtaaggggatccagggcagcggctttcctggctttgatgatctctttttttctttggtcaatatctgaaatgatacccagtatcttcagaagtctcccatccccgtccctgagcgctgtggcatggacatccacccagagataagaaccatccctggatttgagacggtactcacattccatcttgtcattcccctttaagatggcttgaaatccgccccgcagccccgccttatctgcctcatatacaatatctgtggcaaacatagaatccggaaaaccttctgccggaatctgatatccgaatttcttctcaaagttaggagaataatatatctcataggtgacacagtccagctcaaagataatatcctgcatctgtgagagcacgatctcatacctctgctcactgatagcaagctgacgctgtgcctccttctccctgctgatatcatggaagatacagtgaaaccagcagccctcttctttatcctccataacctccgcgctgatccatgcccagcagatagtgccgccttttttgaccagacggttctcatacatgaatacgctgccgttcttcaattgtctgctgatctcccccatgaccattttccggtccccttcatagaccgcatccagaatatggttgtggaaccgttctgaaaattcttccctggtgtatcccaaaaatgcaaacagatgatcgtctgcatctatcagcgtaaaatactcgtcataccggcagttaaatacccctccgccgattttgctcttcccgtctgagctgttcgctttttcattcatcccgatcggcctccttctgccttcagtacccttttccccaacgcctgttcttatactctattgtattacaatcctgccgttttttaaacttttatggcaaaatctgtaatatttttccatattccggtgccgggtgtcggtaacttacagaaagaagctgccgcacgattggcttcatgcagcagcttctttctgtcaggctcagcctgccgagggatttcctctatattttatcagtgttttcttccgtcaaaatggtcacctgggtaatataatgttccatatccgagactgcgatttcattcatcccgatctcataggcatatcctgtgagcctgtaaccatgcttctgcgcaaactccagcatccggctgtaaagcccgggaagcttttcccagctccctatactgatgccccgcagataagtccccggcggctttctgtaaaatccctccacctctgcgggactctccaactgggtatataacccgtcgtagatttgaaactccccgtgccgaatcttctccgcagacagtaagctgccacagcttgtcttatatttgctcagatcccatgccttctgcagatgttccagcagtgtgctcatatcagcaaactccccctgctggacctgagaagacaacggtgttataaaaagatactcctcctcacagtggatcagatcgatctgtccgtccctgacctcaatactgagacgcagcatttcctgttttttctttaaaacattccgcagagtctccaggttctgaatagtctcttcgatctcccctacttttttctccgagagttctatgaacctttgggctgtgggacggttcaggtattctttgatctccccaatggacatattcagttcacggagcgccagtatgctttccagctctccgctctgctgataagtataatagcggtacccgttcctgcctttgtaagcaggtgaaaaaaggccgatatcatcataatagtgaagggtccgtttatttaaatgatgcagcctggcaaactgcccggctgtaaataatattgaattttgaaacatttccaatccccctgacacgttatccgttttctctatagaatgactataccacgttatgaacagacccaaaagagtcatcagcacatatattttttctcaaattcatcagccggaatgggctttgagtacacatacccctgtatcatatcgcagtttacccgccgcagatattccacctgttccggctcctctatcccctctgccacagtctctacattcagcttcttcgccagctccatcagacaggcgatcacatctcttgccttctcactgtgcatatccagaaagaaaagccggtccagcttcaacgcatccacatcaaattccttcaagagtcccagggaggaaaacccggatccgaaatcatccagagagcacctgaatcccaattcatgcatccggcggatgctgtccttcaccacatctatctgctcctcatccaggaatatggattctgtcagctcaaattccaacagctcttttctgaccttgcagcgctcggctatggcggaaaactcactgagaaaatccggtttcctgaaatgctgtctggacaggttcacagagacaggtatctgccgcctgcccatgttctcccactttgccataagtgcacatacttcctcaaatatatacatatcaagtctgcatatctttccgtttttttcaaaaagaggaataaaatctgaggggaagatcacacctttttcggaatgctgccagcgcaccagtgcctcagcccccacagcctcgcctgactttgggctgacctttggctgaagatacacctgaaactcatgacagcgaagggattcctcaaacaaagcgttcatctcctcttcccacttcaggcgttttacaattttctcgtcgtaaaagacacagtctccccccgcctctttttcaccgctctgttcagccaggcgcgcatggtcctgtaaaatggtaatctcctcgccgggatcgcggatcacgcaggccccctgtcggaatacaataggatagcgggggactccctcctgggaagaggaatttattccctcggccatatctttcagccttgtccggatagattcaggctctgcatcccgcagacacagaaaaaagctgtcagattcattcctggaaacaaattcattttcggatggtctgatatgacactgcagtacatgatgtatatagcgcagggtggtgttgcccgcctcggtaccgaacctctcattgatcattttaaagccttttacattcatcatgacaatggaataggccgaaggctccattttacctgccaactcctcgtatttcaggcagaaagccgcctgattcatccctccggtgacactgtcttcaaatgcataccgctccagttctcttctccccgtattgaaaaagcggtaaacatttacaagaaagataagaaacactgccataacaaatataagaatcaggaaaaacctccatatactcccctctgagttgcccgagatcagatcagcgggtatgatggtcagcaaaacccagtcattgattccaagcacatcataagacaaaaacaattcctcctgaaggggagaggtaaattccaggattccgccctttcccttctgcatattcctccgcatctgcccaatctcagacaggagcttctcgtctttattctccttgaaaatatcatccaactgcaaaaacggctttaaatcagtgggggaaaggatcacttccccgctgctgtcaatgatacagctcagactgtttccgtcaaagcttttggatgcgatcatatcctgcattttttccttgctgcgggtacccaccatgacatactccacggacatatccacataaaccggtacggaatagatgatctcctggcctccaagataactggttccggctttgccgtcaaaggattccctgacacagtccagttttgcgatttctctcagccctgtctcatctatggtatcgggaagcggcgtatgtatcatttctccctgcctgtcaatgactgtcagaacattgaactccaacagtctggcctcctgttcaagaaactgtacaagcccggcctcgtcttcctctgttcccgaaagactgctcactgcaaaatccgccgtcatggccagatcctgagatttatgatgcatggtatttccaatctcacccgccatatgggtggtcacatccttcagatattccttggtgctgcgggccagcactttctgaagcccaacagcattccatgcggtaatgatcagcgttatcaggataactgccgaaataatccacacctgcatcccgcttattaaaaaaggaccctgatatacagagcctcttgttttccttcgtctcatagcctcatacatcctcctgctataactgccgaatgatttccgacggtcagcgcagtacatgcgcagacctgctgaatggtcaaaatcattttactataatttgattttgaagtgcaatcttatatttgtgtacgtatgcatatagtattataatattagatatacttaccgtataaaggagactttgccatggaacagaaaaacagattattcgattttttgcatcaaaatctaaaggaccagatcgagaccggaatccttccctacaaaagcgcgctgccgtccatgagccagctctgcaaaatataccatgtgggaatgcgcacagtcagagaagtgctgaaagccctggcacaggaaggaatgatacagacagccgaacgaaagccctcccgtgtcatatacaagcttacagagatgtctgagacagactctgcccttgagccgtccgtgcgcacagccctgaaaaataaatcctctatcctgtctgtgtacgagaccatgactatcctgatgcctcccctgctcgccttctccgcccaggtctgcagtgaagaaaaaatgcagcactgcctctggatcctggaacatgagaaaatggcccgcagaaacaaatggcagacttactcctgttttctccatgaaatcctctccgcctcaggaagcctgctgttccgggatctgtatatcagtcttgaactctatgcccacatcccatttttctgggaacacagagattccattatcaaaccggaagaaaacaggagaaaatgcacttattgggaaaacggacttctgagaccggaaaatgcggaggaagctctgcgctattttaccgggctctaccacttcacaacagataggatagaacaatatctggacaggctttcactggaatatccacaggtacagacagttgataaaaatatatactcctggaatgcagacctgggccgggaccattattatatgcagatcgtcagggatatcattgataaaatagggattggaatctataaagacaggcagtttctgccctcagaagagactctggcacgccagtatcaggtctccgttgccaccatacgaaagtccctctctgtcttgaaccggctgggcttctgcaaaacctataatgtaaagggaacgcaggtgactctttttaatgatgatgccacgttatcctgcatgaaggacaaaaattacaaaaaggatacgctgctgtatcttagcggtctccagttcatggctcttgccgtcccccctgccgtcagactgacttttgaccggataacagaggatgccatacattcactggaagaaaaattcaggaaacccaataccattccccttgatctgatcatggactgcatcaccgagcagatgcccctttaccccttcagagtcattttgaaagaggtgaaaaagctgctgcactggggatactatttttcttactacgcagagggcaaccagatgtcaaatactataaatcagatgggactgcaggcttttaagtatcttcgtgaaaatgaccgggctgccttcgccaaacaactgagtgcctgctactgctatctactgacctttgtccgtgatttcatgaaagactgcggacttcccgaagccggcaggatcgcagaacctgatctgtcctttatccgattttatatctgaacaaaaagaaacccttgtaaaatcttcattctacaagggtttttacgtgggcgagaagattcgaactcccgaccttctggtccgtagccagacgctctatccagctgagctacgcccacatccaatattgattggatagatattaatttattattgcctcagcaacgaaattcattatatcttatggtgcgaaaaatgtcaataggtttttgaatttttttttattcctctttgcttgccattttactactcacagctctgcaaaaacgcagttctgtgaacagcaacgcgcttcgcgatgcacagatacggagcattctgccccatatcgcgctggccgcctcgggattttcatgcgcaggcgcataaaaacaccttgcgggccagtggctgtgaatagtggcttgccatttttcagcggattgtttatattagaaggtaagcgcaatctacatatttataaaggagagatcatcttatgaaatcatcatcagacctgaagaccatgctggcctccattcaccggaaaagttatcccgcctacaaggacttacggggtatctattccttcggcgattatacattatccatcgaccatgtacagggtgacccctttgcggccccctccagcctgagcataaggattcccctcaaaacggctggtttcccctcccattactacagggaaaagcatacccggattgcccttcaggactatctgaacagacaatttgagcagcaggtgtaccatttcagctttaaggccaaaggctccggcaagagcggactcatctctgtcagccgctgcggccaggagatcctggacagaaccgcctgtgagatcaccgcgtcggatctgacggcccgctttaccgtaggttttcctgcaaacggcagaaccatcaatgcgccggaactggaaaagatcctgtttgaatttctgccggtatgcgtgcggaagtcctttctgtacaaaaaccagaacgcaaagaccgtggagagtgtcttctttctcgcagaggaccagcaatacatccgggaagaactggagagccggaatctggccgctttcgtggctgacggcgccatcctgccaagacagagcggtgtatcggacaagccgcttgctgactgcgtccccttctcttccccggactctatgcgcattgagctaaatcttccgcacaaaggaaagatcacaggcatgggcattccagtgggcatcaccctgatcgtaggcggcggctaccacggaaaatccaccctgctgaacgccctggaatccggggtgtacaaccacatcgccggtgacggcagagaatatgtcattgcggaccaaacagcagtgaagctgcgctctgaggatggacgttttgttaaggatgttgatatctccatgttcattaatgaccttcccaacaagaaagatacccactgcttttctacccctgacgcaagcggcagcacctcccaggccgcggctattgtggagagcatggaggcaggttcccgtctgtttttcattgatgaagatacctctgccacgaacttcatggtgcgtgacactttcatgcagcatgtgatcagccgacacaaagaacctatcaccccgtttttggagcgcgccggggatttatatgaaaaggcaggaatctccaccatcctggtggcgggcagcagcggtgccttcttccacattgctgatactattatccagatggactgctaccgccctgtggacataacagattctgtaaaagaactgtgtaaagactttccgcttcccccggcagatacccctgcgtttatccttccgcagagccgccgagttatgagcacccctgatttccgggagcctcagggacgcagaggcggccgcggggcagaaggaaacggacacggaccaagagaaaaccgagggttaaagactaagacacatgaccgctacaccttctccatcggcaaagaatccgtggacctgcggtatgtggaacagctcactgactttgaacagacggctgcccttgcctccatcctgcgctacgcatgtgaaaacctgatcgatggtagaaaaaccctggatcaggtggtgaagctgcttctgcatcagcttgagacgaagggcctctcctctgtctgcggaacctcctacaccccatgcggccttgccatgcccagaccccaggagatctatgcctgttttaaccgtttcagaaggcagtagaacagacatccggccttcatgacaacaggatacggcaggaaattgatcaatctacaaaatatttcataaaaacgtgaggttcatcacggcattgccaaaatgctgcggctatacttatctgcataagcaatggaaaccttccggtacctataggaatactggatcgctgcgtgttatctttccattgtcacagaacgagtgaggccgcagttttttgcgccctcacaccatttatgaaagaggtgaaattatgggttattgttacaagacgcaggatctacagcaagtcttttctgctcttacagaaacttatgacctttacgctcccaaactttttctgaaaaagggagccttttccgacacggatctggtccgctatggcaggatcacttcccctgaggaaatcgtattagacaggaaatcccgcttctctcccaaagaagtgctgtttcccatttcccagaccttattctatttcacagaggacaaagtgacagaaccgaatccccccaaaaaggacgctgtcatcttcctgagaagctgtgaccttcacgcagtgcgccgcctggatcatatatatctggaaaacggccctgaggattcctactacagacagctccgggaccatgtaaaatttgcccttcttggctgtcccacctgttttgactcctgtttctgcgtggatatggggacaaacaaaaatcttgattatgatttcagtctggatcttacaggagatacctggaaaacagacgtcaaatggccggaacgggaagcgcttttccaaaagtattccgtttcagaggaatctgtcaccccctcgtttgtgacagagacaaaaacccgtgtacatattcccgaaaacctcactgccaaagccgccaaaagctccatctggaaagaatatgacagccgctgcatcaactgcggacgctgtaatttctcatgtcctacctgtacctgcttcaccatgcaggatctgttctatacagacaacggcaaggtgggggagcgccgcagagtgtgggcctcctgtatggtggacggctacacggacgtggcaggcggaggaagttaccgtaaaaccaacggggaacgtatgcgctttaaagtcatgcataaggcactggatttcaaacaaagagcgggctatcagatgtgtgtaggctgcggacgctgcgatgacgtctgtccggagtacatctccttctcccactgcctgaaccgactgtccgatgccatgaaggaggtggaagacttatgagaaaaaatgaatatattcctttccgctctgaaataaaagaggtcatacgccacacagatatagagtacacctaccgcatggaatacacaggtgatgtaaaacccggacagttctttgaggtatccatccccaaattcggcgaagcccctatttctgtcagcggcattggggacgactttgtggatctgaccatccgccgtgtaggtaaagtcacaaatgaggtatttgaacagtatgaaggggacaccctgctgctgcgcggaccttacggaaacggattttacctggaagattataaagataaagagcttgtcatagtagcaggcggcaccggtgtctcccctgtccggggcgtgatcgactattttgtccgcaaccccgaggccgcaaagagcgtcactgtcattgcaggctttaaaacacccaatgatatcctgttccgccgggatttaaagctctgggaggagaacctcagcctgatcctcacagtcgacagctgtgaaggcaatccttcttataaagaaggccttgtaaccgcctatatccccggtctggaatttgcgcacatggaagacgcctgcgccattgtcgtaggccctcctgccatgatgcgcttctccaccatggcccttatggaccgaggcttaaaagaagagcagatctggatctcccaggaacgcaaaatgtgctgcggtcttggaaaatgcggccactgtaaaatcaatgatgtctatgtatgtctggacggccctgtctttaactttaccaaaggccgacaactgctggattaggaggtgcagggaatggatgtcaatacaaaggctttaaagaaaaacgcgttccgcgtcacaaaagagcgcggcaaaacagcctcccgtgtccgtgtaccgggtggtcatatggatgcctgctatctatccatgatacaggatattgcagagaagtacggaaacggaaccgtacacatcaccaaccgccagggctttgagattcccggcatagactacacggatatgcccaaagtaaatgaaatgctccagcccattatcgagggactggacatcaaccagaccgaccccggcaccggctatccggcctcaggaaccagaaatgtgagcgcctgtatcggaaaccgggtatgtccttatgcctgttatgacaccacggcatttgcaaagcgaattgaaaaggcaatcttccccaatgatctacatttcaagattgccctcaccggatgtccaaatgactgtgcaaaagtgcgcatgcatgatttcggcatcatgggcatgaccctcccgcgcctggattctgaacgctgcgtaaactgcggtgcctgcgtcaaatactgccgccgcaaatccgtggaggcactggaaacagtaaattaccgtccaaagagaaacgaagaaaagtgcatcggctgcggagaatgcgttctgaactgccctgcttccgcctggaccagggatgaaaagaagtattaccgcctgacacttctgggacgtaccggaaaaagaaatccgcgtctgggtgaggatttcatcaaatgggtggatgaggacagtatcattaagatcatcctgaatacctacaaatatgtggagcactatatcgaccgctccgctcccggcggcaaggaacacataggatatattgtggaccggaccggatttgaggaatttaagaaatgggcacttgacggtgtgcagcttcctgaaatcgcagaggtcaccactcctatgtattggaagggagtccactatacaaaataacgctctgacatgaacaggggggatgctgcacgaaacactcgtgcagcatcccccttcactgtatcatgaccgaatcttcaaaaaattctattatccgaaatgaaattgttcctcccggctaagctcgtcaataacttctgctatggcctcatacactcccggataagtgctgcccgggcctcccacagtaccgccgggaataaaataatgcctgccgcattcttgacatatctgtctggcatatttcatgatgttttctttggaccagttctcacggtccacaacgccattgtcaatacccccatgaaaagatatctgtcctccataggtcttgatcagctcaggtatattatttgttgtcaccggtccctgccagatatccacgcccattttgatcatagacggaaccagattcgccgcataggaatcgctgtgatgcacgatcaattccacaccgttctctctccagaacccatatatccttttataagcaggcagaagaaattcatcaaacatctcaggggacaaaaaggaagagatatgacttccccaatcatcatgatgaaatactgcgtccggatgaagatgcggaatcacctcttttgctgactcaatctcatagccggcaaggaaatcgatcagttcatgcatggcacccggctcctcataaaaattgatcagcgcctcttccattcccatcagataatgtagcttctcgaaaattccaggtgcctcaaaagctgccacaaactgctcctctctgtcaatactgtcagccatctccacaaaaggtttccaagcctcctccggaaatctggtaggcggagctttcacataatccctccatcttgccacatctttcacaaccaccagatcacctttcgtcattggaaacggtccgggtacatttaagggatatgcaatggtaactccccatccattcctggaagtgctgccctgggtacagctgcccatagattccattaaagccggatttgacaccatggctaaatactcaaactgattgacaaaccggtccggttctcccccatggatcgtctccagcagattctgctttattgtcagcacacacatgacctcctctcatgaactgcacaagtcctgatcctttgctcttgaaaagcttacagatcagctctgaggcgtattgccctgcaatctggcaaagttggcctccgcgtactcttttgactttgcctccgtaattttatatccgaaaatatacagcaacgtatagatcagatttgccaaagccgggataccgcccagcagataaacaaagttctgtggatttccaatgacagcagccacttcatcatagttcacagccgacagaacgcctgccgtcaccactgaggatataataaatccaagcttgatggaaataccgaaaagagacatggcaaatgtccggttatccctgccggttttgtaaagctggtactctgcgcagtccagatacagattgacaccgcatacgtttataagcgatgagcctgccaccgccacagcattaaaaattatataatagatggcacctctcataccaaacaacgcgatgcatccgtaccctgctacaccaaaaataccagtgacaatggcagagtttttcttacctattttctttacaatacccggtgctgcaaaagaacagagaagcgccaggactgactgcactgtcatagaagttgtcatcatcatcggctggttcacaacataggaaaagtaatacatggccagtgaaagcatagtcatcataatgccccacctaaacatctctgccagcatgaccacaatgatctgaccgtttttcaaagtttctccgatcatcttgcttgtcttaacacttccgcttcccacactcttaaaatcggggtcatatttatcaaattcttttgtccccagaaacaaaagcaactgccctacaaacccaatgactgcaaattcaatttgtataactgtatatccatccattcccctgctgtccacccacatgatcagtggaagtgtgattatggatgccaggatcgttcctgtattctgcccctgcagcattttactggtaagggccagcctgtcctctatattgggacctgcgatttttgccataagcccattctgggatatctggataaagctcatacctccgccgtaaagaatatatcccaaaaacacgataaccgctttggccataaccggaatagaaggattaataaaacaaagtgtagtaccaatggaaaccgccagaggcccatacaaaagccaaaaacggtattgcccatgcttaaaacataatttctggaccacagcacctgacagcatcccgatgacaagatccacgattcgtgaaaccagcagtatcgttcccatcactgctgccgcgatcaacatacggcttgtcatataaaatacaagatacgttcctgcgatagtcccgccgatcatctgcgctaccatggcaaaaaaatacagccagggaacgcttttcttcattgttgatttttgattcataaatttcacccctttagaatccactcaacccgcagttcctctagctgaacaatttcctgctctctttataaagtgtatctgaaaataattttgtccgacaaaatccggtacacataaacagcctgttctccattttttctgttaaaagccgcccagtccataatctcctcctctctccttgttcacgcaccctgcatgatcactttcttgataactcacgcacttttcactatcatcattatagcatgtaaaaaatcagatacctatgtatgccccatacaaaggatagtatgtaatgtttcgacatttttgtacatataataccaaaatattacatatattttctgttatattctatatatattatatattttcaatgaattatatgaattaacaattaatcttcgactattacaagagttcttcacattaattttgcactgcaatcgctttataatgcattgcaaatatataaacgctctgtttttcagacatataataaaacgaataaaaggtaataccaacgcggaatcataaacctgacactttccggcccactggaatcacaaattgaatatgagactctgataattcaatcaaaaagaactcttccggtaaatatatacgcagaagagtcctcattatcctttattcctattttgtgatcgtcccgtccagatcccacagatcttcccagccttttgccccggcccaaaggaatacctggccttttaccaggcggcagttcttgtcggcaaggcggatcttctccatctcctcctcagtgagcgggtcctcagtagtgcatttcagattgctgatatactgtggctccttcacggagaagggaatcggcacctgcccgcgctgtaccgcccattttaaacacacaaccgccggatgtacctgatgtgcctgggcaatttccaagatttccggcatctgggtatccgcaatatcctcagaggttctgtcgcgctccgggcgtgagggcgagccaatgggacaataaccgataggcacaatattgtgctcctgtgcgtacgcaaacaattccggctgctgaaagcccggatgcagctccatctcaatggcagccggctgtactctgcacaggggaagcactgcttccaatttcggtatggtcatattagacataccgatatggcgcacgaggccttcttccaaaagccgttcacactgtctccacacactcataaactcctctgtggaaaacggcctggaatccgggtttctggaatccccgtcacagccgggtgcatggtaatttggaaatggccagtgtacaaagtacagatccaggtaatccaggcccagatccgcaaggctctgcttacaggatgctatgacctccccatccccgtgcatgtcattccacacttttccggtgataaacagttcctctctctttacaacttgatcatcaaagagcctcccaaggacagcaccgatttctttctcgttctggtaaacagaagcgcagtctataaggcgatatccgctttccacggcaccatatacggcatttgatacctgctctgcagaatatttatcagaaccaaaggtaccgatacccatagcgggcatcctggtacctgtatataaagttctgtaaggcacttttgccggatctactcctttccccataataaacctacctttcatcctggctgccgaaaacaaccgcaaccttgccgcactgtccgcctgccataagcttataggcctcacctgccctctcgatggggaattcatccgtaattaaatcttccggatggatattccaacgcaccagacgctcaaccaactcttccattctccacagacttgtcacccaagaaccataaatggtcttctgtccgtgaataatatccgggcttggattgaaggtacaggttccgccctctccaacgaatgcaattttgccccactctcttgtggcacggatagcaagctgacggccagcatcattggcactggcatcaatggcacgttctacaccgtgtcctccggtcacttccaaaatctcgtccagggtattctcgcccggtttgaacacatggtccacaagtcccagtttcttagccaggtcaatgcggtaatcattcatttccacgccgatcaattgattcgctcccagtgctttggcaagcatgagtgctgccaggcctacagggccaagtcctgtcaccaaaaccgcgtcatttccgctgataccgatcttttcaatcgcctcataaaccgtaccgaatccgcatgctacctgtgcaccgtctttgtatgtcagttcatccggcagggcgatcaggtctttttcttctgccagtatgtacggggccataccgccgtttctctgccagccgtacgcctgacggaatttgctcttacaggaaatgtaatatcctctgcggcagtcattacacacaccgcatccggaaatgtgatatacgatcaccctgtcaccctttttgaatctgcggaggccttcgccctcctccacgataacaccgcagggctcatggcctgccaccatgcccggaatatatccctccggcccttttcccacgtgttccctgtaaatgcagcggatatcactgccgcagatcgtagttgcctttgtctggatcaatacctgtccgtgacccggtttcggaacatcgaactccttcatttccacagagctgttgcccggaagtattgcgcctgccatctttttcggaagcatttttactgccataattgttgtcctcccaaccatgaattccagcgttttctgctgtttcttatttgtccttattataccattctgcgggaaggttattagagatatctgcgacaccttgaaatctttcatgtcgtgttttcgtatattttaaagttaaatcctgtgacgacagccggtccgtgcatagatgtcctttacatatcctaatatgacaaaactgtaagatattctttgaatttgtaaggtaaatcgatggcagacatctctgccatgctctataatcatcactgtaaaacacatattacggaggatttgaaatgaacgaagctgcagctataaataagacaggcgccgccaaatggggatttacgtcctactccctgaaagttctggcgcttctgctgatgacacttgaccatatttattattatttgggaagcggaatccttccgatcccacatatcttcaccctgcttggccggatttccgcaccgctgtttctgtttgccatggcagaggggttttcacacacacatgacaggatggcatatctcaagaggctgtatcttgcatctgtactcatgtcagtgggcaatgacctggtcaattcctttcttccgcacccaaatggtgccatggtcattaacggcatgtttgccaccttatttattgtgggcctttatatctgggccatcgaattgttattgggaaatataaaaaagaaaaattggaaaaacatagagattgcactggctatgctgctcattcccataggttcaggtattgggatcactctgtacatgggaaataccgcatcagtttcacccatcggaaggattgtattccaggccctgtatactttggtgccgtcaccgatttttgtggaaggctctgtttactgggtgttccttggaatcggcttttattttctcagaaataagaaaatcggtctctctgtcttctatgtacttatgtcgggattcttcttctttaccgcagccggcgaaggaatgacctatgagaatctgttcatcctgaatgaccagtggtttatggtcctctccctaccttttatcctgctttacagcggacagcggggaaagaaaatgaaatactttttctatatgtattacccgctgcacgtatacgtgcttgtactactggccagacttttggcctgacaccggactgactctcggtctgaccggaaaaattatatcatgagcaaaagagaccttatccaaaagacagtataatatcactgctgcctttgataaggtctcttcttttcacaatcctggaagctcagctcacggcttctccgaatccgtgcctgctgccggctgctcctttgcagtcttcaaatactccaaagcctccgggtccttcatccggagcattcttgaccactcctttgtggcatcatccctgaccacctctgactgattcttatacaaaaattttaccaattcatagacatccacccagatttcatggttcccttccctctgggactcgtcaaagataagctgtagtccaaaatgcagatgggtcgtatcaatattattcacattttcctttgcgctgtatcctgttcgtcccatatagcccacaacatcaccggcctgaacaacactgcccacctccaaggatttgcagtaggggaagttctgacgcaggtgagcgtaataatagtatcgtctgccgtcaaaactgctgatacccagacgccatcctccgtactggttccatcccatagctgatacatagccggattccacagctatgatcggtgttcccgtctgccccatcatgtcatgtcccaggtgctctctcttatacccatagcttctcgccacaccaaaatcatcataatcgttatagggaaaactttttgctataggactgaaacccttcaggccgtacttttttgtccagcttacctttccctggtcctctgcctctatctgatattctccaaccaacccatccagaactgcgccgtaggcttcccggtagtagtcaaaagatttgatctcagcggacagtttttccactgtagtctcgcctttttggagcctttcggcaatctcatccatgtcttttgccttatactgcttgaaatcaccgccgtatctggctcccagataagccagcaggtccacccagttaagatggccttcctgcccataggtgtccacatcataggcacaggcctgccgcatggcttcacttgtcacatgaaagtccacccactttatgtagtccttctccgcactgttcgtgctggaattccctccattgtccgtttccgaattctctccattgtccgttccagaatcctctccattatctgttcccgaatcctctgcactttctgatgcggaattattttctgcctgggctgtgccacgtccggcggcaaaggcgccttgtgagacatctctccagcaaagcgctgctgtcagggtcagcacaatgacctctgccataaaaccatattttttccatttctgtctgttcatgtccggcccccggtcacattctgtatcagtttatgtgaccagtctgaatcttagaaccaggcggtaaaaaaccacccctacgctttgacctgaaatgatatgatacctctaaagtagacagattaaatacaaaaatctgttattttggaggtatttttcgtgtccagaaaaacaaagtttacgccagaagaaaaagaacaggccgttatagattatcttgatggaaataaatccagagcacagatatgtgcagaactaagcatatcttcaagaaccattcaggattgggctgcaatttataacaaacatggggttgccggctttttaaagaaaatacggaatagctcttattcgaaagaatttaaaaggaaagtggttgaggaatatataagaggcgagggctcgtctattgatttaggaataaaatatgatatttcttccggtcttttaagaagctggattaggatgtataatgccaatagagaacttaaggattacgatccgaaacaggaggtctatatggcagaagcacgaagaaaaacaacacttgaagaacggaaagaaattgttgagtattgtatcagtcacaatcgtgactataaaaatacagccgtaaaatttgatgtttcctatagtcagatctattcatgggtaaaaaagtatgacacgaatggagaaactggattaaccgataagagggggcgtcataaagcggatgatgaagtagaggaattagagcgcttaaggcgtgaaaatctacgattaaagcgtcaactagaagaaaaggatatggtagttgaactgttaaaaaaagtgaaagaattcgaaaggatgtgaggcttggaaaagtgcgccatgaatcaaaatatttggcaatcaagtattttcatacagaaaaaaactggagtattgaatggatgtgcaagcagctggaaatagcaagagcagcttattataagtggctccatcgagaagttcctaatgatgaactggaaaacatcaaccttgcagaactcatcaaggagtatgatgaacgtttcaatcacattttaggataccggagaatggcctcttggatcaatcatttcaaccatacaaaatatagtaaaaatagagttcacaggattatgaaaaaactgggaatccattcagttatacgaaaaaagaagaaaaaatatacatatgctaaggttgatgaaacggcagaaaatatacttcaaagggattttaatgcagctgtgcccaatcaaaagtgggctactgatgtgacagaatttaaggtaccaggagaaaagaagaagttatatttaagtgccattatagacttgtatgacagatatcctgtagcatatgttgtcagtgccagaaatgataatcgattagtatttaaaacatttgataaagcaattgctgcaaatccatctgccagaccaatttttcattcagaccgaggcttccaatacacgagcaaaatgtttaaaaagaaactagaaaaacaggaaatggaacagtctatgtcacgggttggacattgtattgataacggaccaacagaaggtttttggggtataatcaaaacggaaatgtatcaaatgtatgatataacagacgaagcaacattaagatatgccatcaaggagtatatgcatttttatagtgaagaacgtcctcaagacagatatgactgtaaaacaccactagaggtacggcaagaagcgctgacatcagatataccaatagagtatcctattccagaaaacaaacgaataaacaaatataaagagaaatggtgtgcatagaaaaagcctacacttcaattcgaaatgtaggcatcatctacactttattttagatatttcatctgtctacttgacaaggggcatatcaaaacggggtggtttttctacttctatatacaggcctgccttgtgggcggcaggcctctgctccatacctttttattgtatgttgaccactggttgcttttcactggcacatctcaggccgttactattcagcctctcagcttcctagcaactcaggctttttctctcgccttatccagctttacatttctgaaataaagtgccatatcaatggaaatctccacaatattcagtatgtagaagaaccatcccagatagaacagccagtcaagtgatgttcctgccgctcctgcttccatccacaggatcactttacgggcaataccgaatacataaccgatccagataaagaattcaaagaacagactctttccttttgctgttctggaaatccaagatttgcggattgagatcggccatgataagccgaagcagagtatcataagcgcttctaataagtttgtcattatattttctccattccctctctcattttactctttatgctgtgccagatatgcggctcttccctcttcgtacaggttctttccttcactgtcgatgatgacaaaaaggggcatatcctccacatataattttctcagagcttctgcgcctaaatcttcatatgcgatcagctctgcctttttgatacattttgcaagcagcgcacctgctccgccgatggctccgaaataaacgccgctgtattttttcatggcttcaatgacttccggaagacgggcaccttttccgatcattcctctggctcccacggacatcatggtcggcgcataggcatccatacggccgctggttgtggggcctgcggagccgatgacctgtcccggttttgccggtgtaggccctacataataaatggtggcatctgtggggtcaaaaggaagctcctcaccttttgccagtgcttcacacatacgcttgtggcctgcgtcacgtgaggtatagatggttcctgttacatatacggtatctcccgcatgaagagttttcgccagctcttcggtaaggggcagtgtaatatgtttttccatttagatcacctccgttttgtggcgtgttacgtggcagttgatattaatggcacagggcatacctgcaatatgtgtaggcatggtttcgatgttcaggccaatagctgtggtcttaccgccgaatccctgggggccgattcccagcttgttgatcttgtccagcatttccacttccaggtctgcgtaatacgggtcttcattggaagaatcaatggggcgcatcagtgctttttttgcgagaagggctgccttgtcaaaggtaccgccaatccccacacctaccaccataggcggacatgggttggggcctgccgtctcaacggtctccaggatgaaatccttgatcccctgcagtcctgcagacggcttgaacatgcggatagcgctcatattctcacttccaaagccttttggacctacggtgatcttgatctgctctcccgggacaatttccgtatagatcatagccggtgtattgtcacctgtatttcctctgcggaccgggtcttttactacggattttctcagatatcccttgtcatatccccggcgtacgccctcatttacagcctcactcagatcaccgcctgtgatgtgcacatcctgtccgatttccaggaagacacatgccataccggtatcctggcaaattggcacattctgttcgtcagcgatctcaaaattctcaataatattgtccagcacaccctgcgcgatttcccagtcttcacaggctctgcagtttttgatcgcacattttacatcctcaggcagatgctcattagcctggatgcaaagattttcaatgacatctgttatctggcttgccattatttcacgcatatacgttcactctcctgtcttacttgttatctttcatgacgggcatacttaggaagcaataatggagatacatcatcggaagcaatgcctgcgtttttcagttcctctgcatatttttcaatatgctccagtgtcatagagccaagttctgtctcttttgctctggctgccgctgccttacctgcgttacggccgaatacaataatatccagaagagaattgcccatcagacggtttcttccgtggattcctcccacggcttctcctgctaccagcaggttgctgatcgcctttgtaaatccgtctccgccaatttccagaccgccgttctggtaatgaagagttggatatacaagaataggctgttttctcatatcaatatcgtaattcatgtacatacgaagcatggcaggaatacgtttttcaatagttccttctccgccgatcctctcgatcatgggagtatccagccatacaccgctgcccagaggcgtctcaacgccttttcctctatcactgcactcgcggataatggacgcagcggcaacatcacgggtctcaagaggatgcatgaatgcctcaccctctgcattgatcagcatagcgcccagagaacggactttctctgtaacaagcgcaccgtaaatctgtgccggataggcaacgcctgtggggtgatactggatcgtatcctgatataaaaggggagcgcctgcgcggtatcccagaaccagtccgtcagccgttgcgccatagtggttggaggtcgggaaattctgatagtggagacggcctgcaccgcctgtggcgataactactgttttggctcttgccaccatgtaatcatctgtctccatgttctgaagaacagcacctgccacctgacccttctcatctttgatcagctccactgcagatgtaaattccacaacggggatctgtcggttcagcacctcatcgcggagtgtacgcatgatctctgcaccggagtaatccttgcaggcatgcattctctttctggatgttccgccgccgtgggttgtcaccatattgccctctgcgtctttatcaaacattacacccagttcattcagccatttaatggcgtccggtgcttccatgaccagtcttttcaacagctccggtcttgctgcaaagtggccgccgccgaacgcatcaagataatgctgaaccggggaatcgttctctttgtcagcagcctggataccgccctctgccatcatcgtgttggcatcaccgatacgcagttttgtcacgatcatgacattggctccggcttcgtgagcctcgatggctgcggaagaaccggctccgccgccgccgatcaccagcacatccacatcataatctactttattcagatcaatatctacatttaacagacggctgttggagtgaagcaggctgcccagctctgtaggtgccttctggcctttgtttggcccgatcttgatctccgcaaaaccgtcttctctgtaatcaggatgataagcctttaagagagcatctttttcatcagcagtcatacgtctgggttccatgcccatacgctcgtctctggtagcttccacctttttgatggactcaagcatttctggtgtaaacatggtatccctccctatttctcaatctctcttgtgttataaagttcctgcatttctgtgatcggcttctgcatcacctgttcgatcagctcatcatacgcgccttcatggatttcctccacacgttttttcaggtgctgcgtctcaggcgcaatgtattttcctgtaagacgtcttgccagaaggcccaccatcggatgagaaataccagccggacatctcacggaacaacagccgcagctgatgcagtcaaaggattcctccgcgcatttctcgaattcacctctctgggcataggcaatatactgcataacatttaaatcctgggtacaggcttttgtacaggcattacatccgatacagctatagatctccggatataactccatcatgatctgctgtgtaggtttgatctcttctatttcatatgttctcttgtctgttgggaagtaaggaatacttgccacatacatgccttcctccacctgtgtctgacaggcaaggcaggtcttcagctcattgattcctttgatcctataaattgtagcacatgctccgcagaaaccatgacggcagccgcagcctcttttcagagtatatccggcgtattccatggctgtcatgatcgtcagatccgcaggcacactgtatctcttgccgaaaaaatatacattaaccattttttccattttaggtaccaatcctttcatctcggttgagggctttcgccctatgccgcagtgccacctcgattccgctttgcttcatctcggttgagggccttcgccctatgccagagcgtccaatctgtccgcttatgtgcaagcacaacgctgccagcttgtacgctccggcgcactgctcattgctaatcaatactcgtttggcagttcatctatctcgtcacagcggaaaacaggtccgtctttacatacatatttagaaccgatgttgcagcggccgcattttccgacaccgcatttcatacgcagttccagtgttgtgtacacctgctctttggaaaatcccatctcctgcagagctgccagcacgaatttgatcatgatcggcggtccgcagacaagggctgtcttgtcagtggtaaatcccacctcttttaagtagttaggtacaaatcccacatgaccgtcccagccttcctgttcccggtcaatcgtcagatatacgttcacaccctctgtcttcatccatacttcctggatctcttttaactgaaccaggtcgtctgcggaacgggaaccgtaaaggatatccacagtgccgtagttctctctgttgtcaagtacatagttgatcaccgaacgcagaggcgcaaggccgataccgcccgcgataaacagcaggtttttcccttttaattctgtctctaccgggaaatggtttccgtaaggtcctctcactgtgatctcatctccaacctcaaggctgtggagataatcggtaaggataccacacttcttgatgctgaattcctggaattctttattggtcggtgaggaagtaatggaaaacataccttcactgatgcccggtgcacacaccatggcacactgtccaggcatatgctcaaaaagtttgccgccctttggcgcgttcacgcggaaggtctttacatccggtgtctcctggcggatatctgtgataactcccacctgggggatcagggtatccagggtataatttttatgacaggtacattcactcattatttgtcacctccctgtttctgaaaggatttgataactttcacaatatttaaggaagccgggcatttttctacacatctgccgcagcctacacaggaatacatcccatcgttgtttgccgggaagtataccagcttatgcatgaatctctgacggaaacgctgcatctgacttgtacggttatttccgtgtgccatcatggtgaaatcagagtacatgcaggaatcccagcagcggtatctcttgatcccatgtcctgtgtcgtaatccttgatgtcatagcactggcaggtaggacatacaaaggtacatgtaccacaggccagacaaggtttgtacagctcttcccaaagctcagagttgaatttttcatctaatgcctccccattccatccttccagggaaaggtttgaatacggaagtttctcaacgatggcgcggatggaagctttctcttcctccactgtcttctcgtctgctgcatctgctttggtcagaaggctctccacagattttgtgagggtttcccccttctcagtgagagacttccagtaaagctcatctcccgccatccatacagccacatctgccacaggctctgcacaatccacaccgaacaccttacaaaagcaggtttcctccggctcatgacacgccatggccacaatggttccgtgctcacgtcttgcggcatagaaagaatccaccgggtcagctaaaaatactttatctaaaacctccacaccttttacatcacaggctctcattccaaataccacaaaatcctgttctttcagtgcttccggctcaaccgtcagtttttttccatcctttttacaggtatacagatcttcactctgagggaaaaatgcgtctttgggggatttcactgtcttcagtgtatcaagggccacctctgcatcctcgctccaggctctgaagttcacctgtccgctcacttttacaggcagatataattcctgagtgccggcaattaactggaataatgccgccagattttcttttgctgtcttatacatacattatcccctttctgccacaatacccggctctacatcctcaaatgtaaagtctgtcagcggtccttttgaatctgtgtcttcaccggcctgatattccccgtagaactcatcaatgtccttgatgaatttccggttgaacagatgaagcggtattccctggggacatacacggctgcactcaccgcagtctgtacagcgtcccgccacgtggaaggcccggatgatgtggaacattttctcttcaaaggaatccacattggccttctgggaactgtcgaatttattactgtcaaatacacattttctgcagctgcatgcaggacatacatttctacaggcattacagcggatacatttgctcagttccttttggaaaaacgcaaatttctcttccgggctcatggcttcaatggcagccacaccgtcaaagcgttccgcgtcctttgtctctttggattcccctattatttcatcgtagatcttatgctcttttcctttgcacacatggcatctctccagcattgcatccgcgtaagaacatgttttctctccatagagagtctggatggtaaggatatctgcttcgtctgtgatctccgcaccggaaatgttctggattcccttgatccccatgctcttgatcttctcaatgtccagcttgcctttgcagccgacaccgataatataggctttgtctctgtcgactctgtgttccttgatgagctggttaaagctgtaagtatcacagggcttcagacataccagggtttttccctccagcttggaggcctcgatcatatatttgctcaaattggctccgcagaacccgttatatacaaagttttcaaagtcttcttctttttcaaaatacgccggttccggattgtaaggcaggtctcccgctttccagccgaggacacgggctacggtaccgtccgctaacagctcttttgcacggctcactacttcctgcatctcaaatcctccaatcttacgttcttgcccagagagcggactttttccacaaactcattcatggtcgtggagaatttaacgccctccgctgcggacacccattccacacgggtacgtccgttttccacaccgatatagtcaagcatggagaataaaagtgtcatacgccttctggcatagtaatttcctgtgctgtagtggcagtctcccggatgacatccgcagaggatcacgccgtcagcgcctttttcaaatgcccgtaaaatgaacataggatttacacggcaggaacagggcacacggatgatcttaacgtctgcagggtaggaaagacggctgcttccggccaggtccgcgcctgcatagctgcaccagttacagcagaatgccacaattttaggtctgaattcttcttttgcttctatcgacatattgcatccacctccgctatgatctgtctgttggagaatccctgtaagtccatggctcctgacgggcaggcaacggtacatgcaccgcatccctgacaaagtgcgttgttcaccactgcaatgcggcgtgtctcacggattccgtggtcattcacctctttgtcctcgtaagtgatggcaccgtacgggcacacatttgcacaggtagagcatccgttacagagaagttcgtcggacttggctgtacatgggttagtcatcagtttatcctttgcaaggagtccaatggctttcactgctgcagcccctgcctgagaaactgtctccgggatatcctttggtccctgacatacgcctgacaggaaaatacctgctgtgggggattccaccgggcgaagcttgggatgtgcttctgtgaggaagttgttggtgtcaatgctggctgtgagcatggtggcaatctttctgacagaaggatctggctcaatagcggtagcaagaactaccatatctgcttccatgaggatctgcttgttatcaatgaggtcaacgccctgtactaataactgtccgtttggctggggagcgactttacccacctggcccttgatgtagttcacaccatattcctccaccgctcttctgtagaactcatcaaagtttttgcccggggtacggacatcaatgtaaaatacagtcacgttcacatccggatatttatcgcggatcaacatggcatgttttgcagtatacatacagcagatcttagagcagtagctcttacctctcttatctgcacagcggctgcctacacactggataaataccatattcttcggagcttttccgtcagacatacgctctagatggccctttgtgggtcctgccgcattcatgatacgttccagttccagggatgtgatgacatccttgctctggttgtacgcgtactcatcgtaattgtccagcttgatggtgtcaaaaccggtggcaactacaatggcaccgtacttctctgtgaggatctcatccttctgctcataatcaatggcacctgcctgacatacttttgcgcagacaccgcatttacctgtcttgaacttgatacagttctctctgtcaataacgggaacattggggattgcctgggcaaacggtgtgtagatggcgcttcttgtgttcaggcccctgttgaactcattggaattcttcttggacggacatttttcctggcatacgccgcagcctgtacacttgtccatatccacacttctggctttcttgcggatatccacagtaaagtcacccacgaagccggaaaccttttccacttcactgtatgtataaatattgatcttctcatgggcagacgcttccaccattttcggtgtcaggatacaggcagaacagtcaagggtggggaaggtcttgtcaagctgtgacattcttccgccaatactcggagtcttctccacaatatccacttcgtatccggcctctgcaatatcaagtgcagtctggatacctgcaataccgccgccgatgaccaaagctcgttttgtgacgagactttcgcctggcttcagggatgcgttcagatttactttcgcaattgccgctctggcaaggataacagccttcttggtggcttcctccatatccttgtggatccaggaacaatgttcacggatgttggcaacctccaccatgtatgggttcaggccggctctctccgctgccttgcggaaagtggtctcgtgcatacgcggtgaacaggaacataccacaagtcctgtcagtttttcatttttgatggcctctgcgatcttggactgcccggcctcggaacacatatactgataatcctccgcatggacaacgcccggttccattttagccatttccactacttttttaacatctaccgtagcggcgatgttgctgccgcaatgacagacaaatacacctattctctgcacttaaacctcacctcctgtatcttctgaatgcactgactaaaagctgctgtggaagttccgggtccaaaagctcagggatttcatcggctgtcaggtaatccccgcccttttcacggacaaccagctgtcttgccgcgtcaatgagttttcccggtttcacatcccttggacagcgctccacacatgcaaagcaggagagacatttccaaagggattttgaatttaccagggattcgatatcttcattctgcacataggatacaaactgatgcggtttgatgtccatttcattgtaggatggacatgacgcagaacatttgccgcacttcatacatttcagcggattgacgccgctgatttcctttatcatttcagcctgtttctttggggtattcatgcttttgctgcctcctctttcacgccgagagcctctgccagaagctctgtaaagtaaaatacaggaagcttgctgccgctggtgctcttattcaggttatacaggcataacggacatgctgtgatcagcatatcagctccaaagccggatgcgctgtccatgatcttgtcagacatggtttttgacatctctttttctttcagggatatgtaaccgccgcagcactcattcctgtatgggtaaataacaggctctgctccgatggcccgaataaaatcctcaatgatagccggattctccggatcatcaaattccagaagtccacttggacgaagaagcaggcatccgtaataagcgcctatcttctttcctgtgagcggagctgtcactttctcctttaacgtatcgaaacctatgcggtcacggagcacctccagaaaatggagcactgttgtctcacccgcatagggttcttctaactgcatataattatttgctctggtacgaatgtcatctacattcttcatatcatcattgacacgtttgatcacatgatgacaggccgaacagagtgttaccagatcctggcctttttctttggcctcattgagagcacggacggaagaaagttttgtggcgatctcgtcagaccccagcggataaacgccgccgcagcactgccagttttcaatttcttccagttcaaatcccagtgcccttgcagaagctctggcataagcgtccagttctactgcttttgtcttcagggtacaccccggataataactgtacttcatagttcctcctaataatcccggaaactgtccagtatccttatagtccccgcttggcggaccaaaggatacggaacagtcatcctgtttctacagttctatctgtttgatcacttctttcagcgcgttggcacttgcctgaagtttagcgatctcttctttgttcatacgcattggcactttgccctggataccattggggccgaccagagtcagggtgctcacgcagacatcctcaatgccgtattccccatgcatcatagaggaaacggttgcgatggaatcagatgatgccagcaggattccgcagagcttacatactgctgcagataccgcgtagaaggtagcacctttatttgcgatcaccttgccgccagacttctgaacataggtcagcatttcgtctttatccagcacatctacctctttgccaaggttcttagccagttcataatactcatctacactgacacctgatatataggcacctgtccagggaatgaaggaagtgtcaccgtgctcaccgaatacataagcgtggatatttttctgagcaactttaaagtgttcagacagtccgcagcggagacgtgcagtatccagaattgtaccggaaccaatgatctgattctcaggcagtcctgaaatctttgtaaatacataagtcataatatcaacaggattgcttacgatgatgtaaagcgcattgggcgcagcttttacgatttccggtgtgatactctttaaaatattcacgttagtctgtgtcagctcaattcttgtctgaccgggtttgcgggcaatacctgatgtgatgatcacgatatcggaatcctttgcatcctcgtattctccggctacaatgttgattggatcgcggaaacaggtaccctgtgcgatatccataacttctccggcaaccttttctttgttgatatcgatcaatacgatctctgatgcgatatctccgttagataatgtgtaagcaattgttgagccaacgcttccggctccgatgacagtaattttactactcatgcttgctcctttccccttcctttgggtggtccttattgtcttttttttaacaatcaatattcaaaaaaatgtgaaatcacaaattctatctccataagtatgtttttctgttaaaacatatttactcagcccccctggtttacagggctttttagaagaatctgatttcgcgctacggattaaggataccatattgacaagaaattaacaacaactttttaacgattttttgtacttttttgcctcatctactacgttagtgtagaaaagtgcactttcaatcatcctattttttctgcgtgcattgaaaaaacagaaaatgctttattttcttgtatttttgcgcgtgcaatgtgttttttgactatttttatccattattttttcaatttttttcttgggatttagtggatattttatgtgtgtatacaaaaaacataatctgtcattttctgtattttccacatgtttttaaagcgtgcatacaaatgcacactgtgttcacaaaaaagactgccccggttggcttatcatttataagccctcaaggcagtctttttattatatcagacatgttagtcaaatatcttttttattctttaagctcccatatttttgtcacagacaaacttttatgttcaggtattaaagaatcggaaattccaccgtcaccacaaacagatccgcatccacttctatcccaaacatacctccgcatgcctccgtaaagctcctggcaatggaaagtcccaatccgcttcctccgtcagtacggctctcatctccgcggacaaatctctccgtaaagtcaatgtctgacggaatctcctcctgggagatattttttactgtggtcctggctgttctgctgtctgccttcaatgttatgaaaacacgggatccatccagtgaatatttgagggcattctgcagaaggttctgaaatactctgtaaagacggctgccgtccgcatggatcataacggcatctgccgggatctgtgccttaactgtcacagaactctcttcaatctgttcctccatatctgccagagtctgacggagcagtttgccaagatccagatcttctaaatttacaggaagctgctttgacgccgctttactgatttcaaaaacatcctgtaccatggatttcaggcgctgggattttgtatccagaatacggacataatctttcacatcctccgggagattctcctcctgcttcataagctccacgtaactgataatggaggtcaggggagtcttgatatcatgggatacatttgataccagctccactttcatgcgctcactcttcattcgctctgacaacgctgtatccattccgttctgaatatcatttaactgctgtacggcttcatacagatctgaatcttccggcactatcagcttatctgtcatatttccgtcatggactttctttatctgacggatcagatcgccaatttcatttgcaaacttttgattatctgatgcatattgtttcatcatacccaccagcagtacgatcaaaaataccacaatggccacaagcagcaataccgctgcaaaactgcctccatcatcatacagataaaacgctgacacaaaacatgccaaagccgcaatgactgacaacacgatacctgatatcatcaccggtgaaaatttacggatcatttgtttttgaaaggggtactccatatttcttgtctgaaatagtttctgtatatccctgaccaatgtctttctgggcttttttctgttatacctgtagtcattgatgaggatatacaagatccagaaaaataccagcagcaatatgggatttccgaataatgtgtacatcattggatagaaaatctccgatacatactcataatagtcccatccataatagacatccatatagttgttgatccctacgatccctcctgcgatcacaagaactgccagacctattttacactccatccagacttttcccgtataaacagcaaggaatctgtcaccgtcttttttgtactttctcagtaccagataaatacccagaagcacaaggcccgcaataaactctgcgattttagcaatatagctgtccttagcatgtttcagatttcggaccgtgtcgtacaggctgcttgttccataatagcttcctgaactaccggaataattctcctgcacataatttaccggggattttctcactgccatacgcacttcagctttttttgatttgtcatccacagtataattcttataccccggaatacgccatttgctgtcgtcacggtattccccgtttccatatacgtccacagcttttttgtctttgaatacggaagcctttccctctgcaaaggacaagtaaaaattgtaatcagaaggcagatttttttctccgtctttcaaaaccccatccgcatcatttgtatatacagacttgccattataccggatatcgtagagcaggttcttatcattttttatggtctcatgtacctgcttagccgatgttttatagtcccactcatccgagatatcattcccgtcccagatggcttccgcactttcctcagccacactggccatggtactttccgttgtgccactcccccaaaagatgtcctcagaatctccggtgactacatccccatatctgccataccaattcaccgggcctcctgcggccatggaaagaaagatatccagataatctgacacaaagctgcgaaactcctctgtctcttcaaagtctgaggtaaacgcatccttaacactcactccccgtaagttattccctgccagcaggttcaggccagtcaatccgctctccataagcagacagatactcaggacaaaagccgcccaggctgttatcactttacattttttcgattttatatccaattccccacaccacctttaagtattctggctcctttggattcagttcaattttttcgcgaatgcgcctgatatgcaccatgaccgtattttccggggcaaatgcatcttcttcccagacacggcggtagatttcctccgctgaaaatacacggcctaaattgcgcataaacagatccacgatttttgtctctgtggcagtgagccgcacggactccccatcagcatacagcacacgctcctcagcgtgataacagagacggccgctcttaaactccttggcggcgcttgccgcattaatatcccctaatctggtatatcgtctgagatgactttttaccctggcaaccaattcctgtgaattgtaaggctttgtcacataatcgtccgctcccatggaaagtcccaacaccttgtctgtgtcctcactttttgcgctgagaacaatgatgggtatatttcttctctccctgatcttcataatagcggataggccgtccatacggggcatcatgacatccatcaatatcaactgaacctggttctgcgccagaagatccaacgcctccaatccgtcataggcccgcaggactttgtagccctctctctccagtaaaatagctatggccttgactatctctctgtcatcatctgccacaagaatacattcgctcatgtttcctcctccttaaagcttgtatttataataccccctctgtcttacaaaacaactgacagattccttacagatttcttacaatgctctagcaggccagtcattatgaaggtttcaaactttatggactactagctaaaataggagaagcacctgtggtacttcccctactgtctcatagattcatatttctatcagtataaagcatatttgacctttttacaagccgaaccggtatggctgctctgcttattttgtacccttccccatttccatgcgcacgacctatctattccatatcatccggaatgtctaccactttccaaacttctctataccctattgcagaaatctttacgccatccctgctgttgctggcatgtactacatttccatcgcccagactgatagccacatgatcgggcacatgatcccttgcgtaaaaaacaatactgcccggcgctgcctcctctggaggaatatcccggcctttttccgccacctcagccatatcttcaggaagcaatatcccagcctcctgataaaccgccctcacgaatcccgcactgtcggttccgcccaaaagattttttccactgtatatataaggttttcccacaagtgtcctggaaagaagcgcgatctgttctcccagtgtatctcctctttccatttcggaaggtaagaccagactctctcccttgacccccggacttgtaaaaaacattaccgttggaagtatcacaagcatcagcgcacctaatacattactgcgtgtccagcttttcattttcatgatcgccttaagcctgcctgctaactgtttttctgaaaagcatacatttgaagcactccccatcccccggttttcttccattctgataagagtcatggcatactgctccctgctttggggatgaagtgtttttaccaccttctcatcacaagccagctctatatcacgctgtgccaggaaaaaaagtatccacacaacaggatttaaccaatgtatacaaagcgcggctgccagcagatacttcagccccacatccattcttttgatgtgtatccactcatgctccagtacataggtcagcgcttccagatcggacatatccatgcaggatggcaaaaggatcacaggccgcaggataccatacgtcattggggaggatatggtatctaaagttcttatccgaacattcctgatacatctgtgctttgcctgccagtgctttacgcctatattttctgccggcagggaagtcctggcatggagcaggaaacggatatgtacggcaagaaaaacacagccgataaccaggattcctgccagccaaaggcatattggaatcggtatcccctccgcacctgcttttgtaactgccggtgctgcacgtgtgatccgttctatcccgccttttcctgtctcctgaaatccctgcgccgtaatggcacttcttatcccgaaagatccgccgattttttccagaattgtatacaaattccatctggtctccactgaataagggataagaagcctgaaggctgcagcccaccataaaaacacaaaggtacgtttcggtaggcggtaaagtagaaacattctgaaaaaaactgccgtcaatatcagaagggatgcctgtgtacctattgtccaaatacgcatcacacacctcacttcaagtcttctaccaactttttcagccggacaatttcttcatgtttcagctttttattgcctaaaatagaagcaaccagcaaatccggggaaccgtcatacattttatctatcagctcattcgtctcaaactctctggtctcctcaatagtcaccaggggatggcagagaaagttaggctctattctttctatggctcccttatctatacatttctttatcactgtataagttgtggtcttgctccatccaatctgttctttcagttccgccgcaatttctttcgcgctgatatcgcccttcttccatagcaaatccattacctttagctccgaatcaaataactttactgtcatggcaaaacacctttcctgatatgtttaatattattttaacctatcaggcgtctaactgcaactatcggcatataagcagcattatcacttaccttgattcctccttttggataaggcgagctgttggcagcgtgtacaatctggccgcctcccatataaatagccacatgccctgagtagaggatcagatcccctggctgggcttcagaataagatacacctcttccgcactgttcctgatccccggtatagtgtggcaggctgaatccgaaatgctcataaaccttcatggtaaagccagaacagtccaccccattagaggctgtactttacgtatagtctctttttcttttttatgtccactaaaaagccccccgcgggtgtaccgcccccccccaaagttaggccaaaaatctaacaattggaggtcgatatttttatggcaaaaaatatggatacaacataaaaaaagagttccaatggagaatttaaatggaaaaggaagttccagagacctggctagaaagtacaatataggaacttcaggcgatcacaaacaagttattagggtggttaacgcttatcaaaaattcggtgatgccggtcttgtcgtcctccctactccgagattctgccatcttcgatacggacaattacttatgaatccaaaattcccatcttttatgatctctgaccagataaaatatccgccatacttcgcagaaatagtaagatactctgcagccatattttcaattccacttgcccacacccaataattctcggtacagaaaatcccctgcagacaactatattgttcgtacatctcctggatccatgccgttttaagccaatgcgcagctgtatagtaatattgatttctcgctgtatacacagtaagtactagtggaattggttcattctcccctgtctttggatttacataattttgtgcctcctcaagaaaatgttcgtagaaatctgctgcgcttccatcttgttttagcagatcatccgggtacagttctatcactgtgtaaggttttagatcgtctggtacttcctaccatttccctgtcagtgtatcatcaccccagaaagcatattgccgctcagcctgcgcatatttttctccattggcatatagcggaatcatcatcagcggaacttgatttgatatttcacgacgtttttcctcaggttcccacgcatcgggatctataaatggtccctctgccacaaccttggcatctgcatatacaatttcatctgcccaggtttgttctccggcataacattttaaatgcagcatagatgcattttcagggacctcaacatctacgcggatcgcaggggtcgtatacagaattccttcaggatagtcttcctgagacgagtagagaatcgtatcatccgctaaaatctctattttatccacaatagcatgtcccgccgcttgatagtttgcgctccggtcaatccttatgtaggcttgaaattcagaaactccatccccgttgatattataagtgatttctgaaggatatgctgctacagttcctaagcccttttcaaatgttcggatatttccattttgcattagcagccggataggtgtatcttcgccattatttcccagtgtaaacggatggtctttctgtacttgcttgctcgtgtcagaatctccgtgggtagccgactttctggtatttgcaatgttttcctcaaaaggaagtgtggaggcatccagcattacggatgtaaagccaagccaatactgcaaaggcaccaaatatcagtatcagatatttggttttttctctgaatttttctttcttcataattccccctcattttctcatctttgactgtaaatgtgcagtccataaaacagtcgttttttaattatttttgataatattttatatattcttgtgttaaaacatcatgttttgagctattagtcaattttgagtatttttatttcaggataaacggtcagcctggcagagtgctgcgggtgtctgcgtaaacggcgcccatgcccgcccgacattcggtttggttatgaatagttacctttttctcttcacaagttactcaaaatgtaatacaataagaattaagcacagaagcaaatctatagcgggaaaggcttggaatatgcgcacaaaaagaattgctctcatagaaaattatattgaacaggaaaaatccgtatcccttgatactctctgtgagaagtttcaagtatcaaaaaacacgatctgccgggacattgataatctgagcaaaaaaggaaccgtacagaaggtatacggaggagttacctataatctccctgcatcggatgccagactcctcccctatgaacaacgccatacggttctcagccaggaaaaagacaccatttccaaaaaagcagcctcctttgtacaagtcggggatgtcatttatatagacacctggaccacctgcctgaatatggtggactatctgtcgcacttaggctgtacggtcatcaccaacagcctgcagatatatgtaaaatcagtgcttttccagaatctccaggtcatctccctaccgagcattctgaaccgggacaccctctcctttgtaggtggggagattcctggctatctgaggactttcaatatcaccagggctttcatggcctccacaggcgttaccattgcaaacggtctcactaacgcctccgcagaagaatacgtgataaaaaaagctgtcatccagaacagccagattcgctatctgctctcagaccacaccaaattcgggaagtttgctctgatgacctattgccgtctgaacgaagtacagcacatattcacagaccttcccccgggagatgaataccagaattatttcaaaaaatatgatatcaacatacacctggcatgaccagcaacactgattaccagaaaaaggacggtccagacatggcaagaggaaaagttccaacaatggcagctgacgactctcggcagtatatgctgaacgaaaattttgagatatacgaaaaattcggagtccccagcggcgccacggagatgcattttcataattttaacgaaatcatatatataatagaagggcagtacacggtcctgctcaataacaccacctatcatctgaaacagggcgactgtcttttaatcggccaaaaccagctccaccattaccagcatgagccgaaacagcatgacgcctgccgccgtatccttatgtgggtttccgacagttatctggaacagttgtcaagtcctgacacgaagctgtcccattgtctgtcctatccctaccctgcatggcaccttcccacccccgacagaaaacggctggagcagtatctgaccaaccttctctatctggaggcagacagccttatgcccaggggagaggcaaggcttttaaaaaatgcctatataacactgtttttcatctgtttaaaccagatctgccggcacagcgagctggccctgactacagagaacacctgcatccaccctatgatacgcgtcctgacagacttcatcaacgaacatatcagcgagcctatcacgctggacatgctggccaaacaggccggatcaagcaaatatcattttgtcaggagctttaaaaagctgaccggaatgactgtccacgattttgtgacccacaagcgcatcatcaaagcctgcgaaatgatatgggacggacagcccttaggagacatataccagttctgcgggttttctgactactcctcatttttccggaatttcaaatccatatacgggatatcccccagtgacttcaaagccttttacgaaaaagaacctctttcttaaaaagaaaaaaaggggttcttttctgcttatatcctgcaataagttttatccggtcccagataagaggaaagaagttctttttcctccctgcatatcaccagtctctccaaaacaacacctgcatcttgtccatatatcctcagatagttcataccctgcttaagtgtaattcccatcctgcatacatgctcctgatcaaggacagccttcgcccattcggcgcaggtgtggtccccccctctgtagtccccgccaaccaagtaagcctggcgcatctcctcttcatttaccgatacgcccagtctcaggctccctgcatacctgagaggatttgccggcgaagtgtgcagctccagcctgcaactgcctgctgcatcggcccacagtccatagacaaggcaaggtgcattttcctccccttcaaaggaagcagtctccggaaacaccttcacacctgttccgtatttcccatagccttccagcttctcaaagactgccctgtgtccctcaaaggttcccggtgcctgttctagataatccgcggcgtcaagtacatacacaccgtccctgtccataaaggctccccggggaacagaggtaatatcccgcctctttgcccggatcacaacagggagcgcttcctccccatggcgtatgtgaaaacaaaactccttttgttcttccttcggaagcctgcccagggatatcctgatcctgatatcatcttccatatctgtgctcccctcacaggcagaaaagctcagaaattcacacctttcctcgattctccattctagccttccctgaccgccgttggctacctgcaaagtgatctccctgcaccccggatagagaaaatcttccataataaagggaaccggaaaatactggtttgtataatatttttcagagtcagcggcagacaccacaagtctgggcgtcccgggaagtctcagcacatgtcgcactggatagcgccagtcttcactgttccaatttgtgaatccaatatggggcgccatctccatccccttccacctgcctcccttaaatgcagaaagttcctgggccagatcttcatcccttagtatgcatgtgtccatccattccccatacacattagccatcgctttcccctgggaggcatacagatgattgaatcccgcgtacagatgcatcttcagaagattggcggaagccgctgcaggataataaatcatgctgtaataagcctccctggcttcctctgcctccagactcctccatacctcctcatttacctcttccaggcggtttaagcgtttcaacattcttctgccttcatgataatgaaccggatgatacacaccactgctgcatgcctccggtcttcgcagactgttgataccggcagtctccttaagtatccatgcgatctggctgacctgctctttcttcgcatagcttccaaagattttctgtgcccagaccgccgtatactctctgctcctgtcatagcagcctgctccccagttctcataatcataagccagttccatgaaatatcccagcgggtattcttgaaacttcagatctcccacattgacgatccacagatcccggatcccgtattcataagcctgtgtcatctgttcccatattctacagacaggagtggaattttgccactcataagatacaggcgcgccgtgatagtccagatggtagtacatgccaaatcccccgcttcgggcgcgttcctccttttctggcagggcacgcatattgccgaaattatcctcgcataaaagtagtgtaaccccatccaattcctcaaagccgttcaggccttcctggtaactgccgccgaaataataatcctccacctctttatacacagcaaaaagcagaggtgtcttatccgcatcccggcccaaatgtttccggatcatttgtctctgttttttgatgatctctttgagcaggcgcacattttcctctatgtcagaatcctcgcccagcattttgctgtcccgctctcccctcatacccagtgtgggaaatacctgatgacccttgcttctgataatcccgtcctcccaatatcttagaaggccttctttattatttacataactccactgcgtaccgtaaggagtgtcctcccctttgcagatatcccactcctcgctggaacgcatacacggctcatgatgagacatgcccacatagattccatactcatctgccagttccatagaagccatccccggcccgtccagcataaaggaggaagtccacatagccggccagatatagttgcccttcatgcgcagcagatattcaaatactttgtcatacatctctgccgtaaatccctgataatgtgaaaaagtccagtttccaaagcagggccactcatcattgataaaaaagcccctgtatttcacggaaggttcttttgaaataaagctgttacattctatatagcacacctgcccttctctcttcttggagatttctgtgcatagcaccgtatgttgatgaaagggaagaggtgcgtctccccagaaggtccagggcgtcgccccgagaagctccgacaaatgaaagattccgtagatgatccccagcttatcgcttccgcagatgatcagtcctctttccaccccttccacaggatgatctgccaggtaaaatccataggcttctcttcttccctgtaatctgtccagtcccccaatcctctctcccaggcgctttgagagactgcccttcccccacactgccacgatcacagcctgctctatattccccgtcccttcctgacaggcgggcctgcacatagccccggtaatccttctgatatcttcctcggcttttccccatatttttctgattcctgaatccgtatcaggatccatgataacaaaaatctctttttgtccgtctagctccaaataagccatcttttctctcctctccgctgcattttgccaaaatctgtttatgagtcagaaaagccaccgcagcactctgccgcggcggccttcccaagtgttattacagatcacatctctgatcaataacccagaatatcttttgtattgttgaagatttcatttgccttttctacatattcctttgctttcaagttctcctggcactctttgacataggaatcccagtcagcctccaggtctttcttgcctgtgataaactccagggctgaagtatttacatagtccataagaggcacctggatcagattcagctcttccttctccatctcatctgccaggatcgggggcatgagcgacacatcttccttgttggaattgattctctcattccactctttctccggcgctgagaacttggaaagctggatgaaagtatttccgccgtaagcgaacactccgccgccgaaaccataatccacgttgagctgtttctcagctcccgggttaaagccattgaaatagatatcagaattcaggacaatattgccgtctgcatcctttgtgtaggtttccccttcaacaccccactgacataactcatgtccctcgtctgagtaccacagccagtcgataaaacggagcattttgataaattcttcttcacccagttcttccagggcattcttgctgatcatgataccattttccagacgtccggcagcgctggataatttcaggttgcctgcaggtcctgacggcgtggtaaggaagtacagctccgcaccctcatctgtcatcttgttctgggactgaatatcagaaagaatctggtaattggcagcaagcacataagaatcgccgcggaagaatttcgcctgggcctgcgtgctgtcctgggtaaaggtttccggatccagaatcttttcatcatacaatttgtgcagataagtgagaaattctttatattcgtctgtggtatctgcgaaataaaactcatttttgtcaaagtcgaattttgttccgttcttcaggccccagtcaccgccgtcctgagaatttcctgctgtcacattgtatgtggcggcagccatgttcatggtacagccgaactggaactggtcagaccagatattatcttttctggtatgttcctgaaccttcttaagcgcgtcatataagtcttcccaggtccaggaagcctctttgctcatgtccacgcctgcagcctcaaagatatccttgcggacaatgagggagtatcctcctgcaacagattcccacatacccgggaggcggtaatacttaccgtcagaggcataaatctgttttaagtcatcctccatgccccactcttctacctgtttggaatagttgggcatgtactgcacccagtcgctcacagccactacctgtccgctgtcctcataaggtgaagaatcataaatcttaggaattatgtaaggcgcgcttccgctgttaactgtagctgtcaccttgtcgttatagtctgttctcgcaacagaagtcaggtcaaaagtgacattcgacctctcctcaatggcgctccagattctccaatcctccttcagaggatagttttcatgatctgagaacatcatagtgtaagtcactggcttctccgaatggaatgtaacaccctctccgtactcataatccagatccttgtcagcctcttctgcagacatggtgggtccttccttcttgtcagagtctgaacctccgcacgctgtaagagaaccaaccataactgcggcaagtaataatgatactgctcttttcttcatacttctttaacctcctttaatttttcgcttttatataaagcacagactgtgctcaatataccatcctaccttttgcggcaggttcctggtctgtcgtttgtaaactcatacctcccggtatgaaatcctttcgtcgagtaaaccaagggaatttcacccttagtttctcacggaaccgtacgtgaacctctcagctcatacggctcttatcattcaactcattacaacattcctgtttcggtatttccaatgcgcaaacatatttggctctctcttttggacttcagacagccacttttctgctctccttctatgccctctgaacctcttatatttgcacatcgcccattttattatccgcctgtccacgcaatctaatgagtacttgattgcctgtgggttgtattttccataatagtttatccatcccctgactatcgggtttatgttttccgctatcatttctattttacagccagttttcttatggatttccaatgctcttatcttatctctgaacgccttgttcgatttcttactcgctgatgctatataattgattcccatcccgccagtcctgtactttatgaacactcccttgaatgtatatcccagaaagtcaaatcccgtttcctggtattctttcgtccggtctttgtccttgcagtacacgattcgggttttctccggatgcagttccagtttgcaggacttcatccttccatccagtgcctttaagatccttcttgcttcttcctctgtccggcaatgcactactccgtcatccgcaaaacgctcaaacggtgattctggaaattctctggccagccacttgtcaaatacatagtgcatgaacatgttcgcaaggattgggctaatcactcctccttgtggggttcctgattcccttcctgtcacttctccgtttctgtcctcaaatggtgttttcagccatctctcaatatatagctgtatccacggctctttcacatgtcttctgactaccttcatcaataattcatggtctatgttgtcaaacagccctttgatgtccagttctattacataatcatatttccaacatctctgccttgtctttcctactgcatctatggctgatttattcggtcgatatccataggaatcctcatggaacatcggctcaacaaccggctcgacatacattttcgctaccatctgggctaccctgtcaaaaattgtggggattcctagtttcctgacccctcctgctttcttcggtatttctatcgccagtacgggagatggaaaatagcttcccgaactcatcctgttccagattttgtacaggttatcattcagcttttcttcgaacttttcaatatccatgccgtcaatcccagcacttcctttgttggcttttacccatttataggcttctattactgcctttttcgggatgttgtaaggtttgccctctttcatccaatcctcctgtttccagttgttttcagtttcaggcagaatgatgacatccctttgctccactgccattacagcagcttcggcactactacggatgtctccgcccctataccatacctctctactttcagcctcacctttctgtggcttgtgccttttcgatttccattatggtacaggttcccacgtttcacagaagcgcctggtatacgctcatgccacctacataccgtctgccggacagccagcgtttcaggttaccgctgttcttatccctacccagttctgaaggataggttttgacagcactcacgctatcgatacttcatcagtggttcactttcgttcatcttcgtatactatacatgactgttgtttgacagccttttccctaattgctcactaccgtagattttggctacagcagcatagggctgtttggtgggtctgcctgcccagtccccaccgaaggacctgccttcatctcctctgtgccttcgtggcacaccagaaccgtacgtgcggctttcccgcatacggctcttcataataacatttgcagtttcatgctacgcatagagattaaagtatctcttggggtaagccagcggataatattccaacatctgcttaaattcctcccaattgtagcttttcttttgacttctgcggttcatccagcgaaataacagttttgtcgtgtgatagtggaacttcaccagtgactgtatgttatatgtcactccgtaataccggtagtgtcctatcagcttgcggttcagtgtcggtatcagtactttcaatggagtggtacggttgttctttaaccactgtctcatctcttttagtttcgtatttagtctttcgccgttcgtctttgggatcacacagaactttcctgcctggttttcgccgcaatagaatgtaaaccctaagaagtcaaaggtctcgggtttcccctctcctcttctctttcttctttctttcgcatatctcccgaattccaaaagcctgcctttactcatctcaatctctaacccgtattttctcattcgctcctgcatctcttcgtaatagcgctccgcttcgctcttatgttcgaagcctgccaggtaatcgtctgcatatactaccaggaaactctcccctttcccacgcttttcgaagtacgcattataccacagcaccagtacgtggtgcatatagatatttgccagtatcggactgatgatatttccctgaacggaacccgcctcattcgtttgatactctccgctttctaatactcctgctttcagatatttctttatcagccagagtatgtttgggtctttaatatagtacccgacgaatttcaatgtacattcatgactcatgtggtcaaagaacccctttatatctgcgtccacaacataattcacccgtttgcggacaatactgatacacatctctttgaccgccatatggcagttcctgtttgggcggaaaccgtacatgttgtcctgcaactttggctcatataccgcttccaatatcttctttaatcctaactgcacaatcttgtcttcgtacgatgcaattcccagaggacgtttcttaccattggctttcggaatatatacacgcagggttggctttggtttataagccttgttcttcagccttttcaccagtcccctgatattctcccttaaattccgggcgtattcctcttttgttacttcatcaatccctactgcctcctttccgtctatttgcttgtgacactcaagcaatagttcttcatttaacaaatggtacagcgatgtaaataccggccggctttcatgagccgatttgtctgctattctttctaatttcgttcccacttatcctcccgtccctgagtacggtaaatgtgtcctcagaaagagcgttattatgtattcccctttcctccaccgtgattagtggtttctccggtaatatgggaatatccgactgcctgtgactcatttggtttccttcttgtcatcgttgtacgccatacttgtccgggagtaagcaatctccctgcaagaaatcacatgctctctccagttggctgattggtcattgtgaaacatgattggccctcggaccccgccaaagccacaacaaactcgcttaacgcctgctgggatgttgtcttccgcatggctaaactgcgtcgaccttttgaagctttgtaaaatttcgaggctcaatagcattgcaaccctatttcctacctgtctacgcttagccctgcctgttaccagtcagcacccaagactcgctaaccgtgactcgctacgtcttgccgtatgggatttccacccattaaaccaaccgcccttttctggacgcacttaacccttgacagctcccattgtcataccctgtacaaaatacttctgcacgaaaggatatacacagataataggcagagatgtaagcaccatagttgctgacttaagagtggcctgcacactgctggcctctgccgtggagcccatttccacagaattggccccctctacaagctgccttacccacagggagataggcttcatggcatcatcttccaagtacaggaacggaccaaaccattcattccacatgccgaccaggtagaacagcaccatggtggccagaatgggctttgacaggggtatgatgatctttataaagctcccgtacactccaagtccgtctatggctgccgcctcctccagttcttcgggaagtcccgcgaagaaggacttcataagaagcaggttaaatgtactgattgctcccggaagtacaactgcccaaatggtatttcccagatgcagccactgcgtcaccagaatatagttcggaatcagtccgcctgtgaaatacatagtaaatacaacaaagggagtaaaaaatttgttcaggcgcagcttgtcctttgacagaggataagccagcagggctgtgcctgcaaccgagatcgccgttcccaccacagaatagataatggtattcccgtaatataggaaaaatttgttgtccctcagaagatacttataagtcgcggtggtaaaatccactggaaaaaatgtaacttctcctgctgccacagccgtatcgctgctgaatgactgtgcgattaggtagataaaaggatatagtgtgatgcacacaaccactatcatgacaatggtattgatcaccctgaacgcctgatagcctttagatggttttatattcataattcctgctcctttctaccacagggatgtctctgtgaatttttttgacaaatagttggcagttgttactaaaacaagaccgatgaccgccgaaaacaggccgactgctgaagcataactgaagttaccgcctgcaatacccatcctgtagaccagggtatctataatatctgcccgggactgtgtcagcggattatataaaagcaggatcttctgcatgttgctggcagtgatgatatttccgatgtccataatcagcagtgtcatgatcgtgggaaggattccgggaatcgtcacatggattgtctgtttgaatttgcccgcgccgtcaatggcggccgcttcgtaaagctctgtgttgatattagtcatagctgtcaaataaaggattgttccccatccaagggcctgccagataccggaaccgatataaacaatatcaaaccatcccggttcggacataaatgcgatcttctcaacccccagctttaccagcagggcattgatcggtcctgtggaggacagaagttctttcaccataccgcatacaaccaccagcgagataaaatgggggagataggaaaccgtctgcactgtcttcttccacatcttgttcttcacttcattgataagaagcgcaaagatcaatgttgccggaaatctcaccagcagataaccgatactcagacgcagcgtattccagaacgccctccagaaattggagtctgtcaggaactgtttgaaataccggagtccgacccagtcttctcccagaatatttgggccgcctttatagcggcggaatgcaatgatattcccaatcacaggcacatacttgaagattacgtagtacaagatgggaatgatcaagaatgtgtagagtttccattcctttttcacatggtgcagcaatggatctttgatctgcacctcttttgatttttttgtctttgcctttgacattgttcaccaccacttccttttttattttccctctataatcacggcttttcaccgcaaaggttaaacctcaatagatcgtccttccctgttcgtcggggatcatggactttctgtagaaatatgtattgacctggtcccgccattcctccgcatgggaggcctgatgttccatcctcttctgcacacgctcaaacaccgtcaccggcactttgctctccagggaattccagatatccagcatctctttcgcctccaaagccccctcaaaatgtgtgtcatagatatgctgtatcagcgttttcccggtactgagcctgtaatcataaggtatgtgatggaagaacagaagcaattcttccggacagctctccctcttcccatacatatctgcatttagcctgcgatattgttccgaataccctgtcccggcaggacttctgtccacgccaatccctttgtggtccgcacggtgataagtgccccagcggtcatattcgtaaccatccacattcggcccgtagtgatatcccggattcaccatccagccgattccgagaggtgaagtatacttctcataagccggccaggacatcataaggattttactgatcttttccataatttccgggtcattgccaaacgtacaggcaatccattcctctgcgatttcttccacgctcagatccatgtcaaaactcagccttccgaagccaaagagattggcagccgccagatcatggcctgtccagttctcatcatcaccggtattggcaaccgcgacgatcccgcagtttgtctggccgaaagtcctgcctgtgacaatatccctgaccctgtcatgatcttccctgcagcaggtcttaaattccagtacctgcttaaacatgggcagcagataacacacatggcgctgctgtcctgtatattcctgggcaatctgtacctccagcattgaatttgtgtgctccagtcctccaaaaagaggagataccggctcccttacctggaaatccatggggccgttcttgatctgaaggatcacattatcccggaacttcccgtccagcggcataaagtagtcatagcctgacttagctctgtctatcttcctttctctccaatcctgctggcagttgtatacaaaacatctccatatgatcctgcctccgtacggcgccacagcgtctgcgagcatattggctccctccgcatgggtcctgccataggtaaacggcccgggtcttccctctgaatccgcctttaccagaaatcccccgaatcccggaagtcttctgtataagtccgccgccttttctttccaccactgctgtacctgcgggtcacaggggtcggcgctttcgtgtcctcccagttccatcggggcagcaaagttaatgctcagatacagtgctatgccatacccggcaaagatctcactcatagcttccagctctctgctgtaatcgtcctcgatcagcctggtggcgcttccttttacatttacattgttgatgacaaccgcgttgattcccacagaagaggcaagccttgcataagctctggtcctgtcgtccaccagaaccttatcctctctgaaaaagaaagaatctcccgaatatcccctttcaatagaaccatccatattgtcccagtgattcagcatacgcagaggcgcagaaggtatctttctgacagaaagctcttccagcggcttttctacctgaagcaaccggatacaggcaaagactccatacagaagtcctctctccccctccgatgccacagtaagccttccggcagactccctaatctcatatccttcttctcccagcccgcagtccggttccagaatcaatctgacagaagcctcctcccagctgcccctttccatatggcatcccagcagttccttcactgcaccctgcaattccgataccgcagtctctgctacaactcctgttccattcgtaaagacacttccgaaatgcccagtattttccgcattcctactcctgcggtaagacagccatgctttttcatactttttttccattttcaccctttcctccttcattgcattttcgagtgctgtttttcttgtaacattgcatatctttcaattcttctgtattttattatatgtcaaattttgccctgccgctccccgattattgccttccattatgcatttattgctcttaaccaaccattctcccctatgtttttgtgtaatttatacataaattataggtattttttatagaatagtgttaatttataatttttaatgagttctcacgtccacacattttgcaattacaacttctcccttccctattctgtccaaataagttttccatcccgaccacctccataatcacagcaagaaatgctatctcatactcatcgtcaggagcccgtatacgaaagctcgatagtaaactaatcttccggactaaacgaacagtttcctcatatcgatcatgaataaacaaaaagcaagaagcctaccgcgataagcgatataaacttcttgctttttataattatgacaccccagaggtatcagcatttttcaatacatagtcacccgttcccggacatcatatgcttcccttcccaaactgaaaccagcaaaaatccaaattgctccccggcaggaacacaaagctcactttctgctttcccgccacaggctccagttgaaaactctgttcctgcattttgccttcaaattccaccatctgtcttacctcttctccatctttggagataaaactgataagaacagcatttttctcaagaggtgtctctgcgcatatggtgattctgtccgccccatggcttccaaaatccatatcatcaaattctatggtgacattgttcccgattccgcagatcctatcctctttctttgtaaaactgtctccgtatatcttatcgcacagggataccatatttttctcccatgcacggctctgacgcaggaaagaaaaacctttgagatgtatcttcttctccaggacaaagcaaatcgcagtgattcctttcaaccttttcttcagtctgtaagtttcctcctggtagacattccatatggaaggtttctgatagatcacatctgcgatcaactccgacccatcctcatccggcaccccttcatagatttttatctcataaggttcatccgtgagtgcaaagacaggcagtacaatctggtcagatccataaggcccgaaatcaatattatggaaggcaatctgactctccccgtcacgcgccgtcgccacgccgtgctcattgccgttgcccacggaacctttgctgtaatcatatagtcctgcactgataaaatcataaggatcaagacatgcctttccaagccctctcactgcaaattccaattgagagacaatccgtattttattcgtgccgcagcgggacatacagcgcagccggaactgtccgtcactctttgccgcaacccggacagacacttcatcctgcggtctgatcacagccagggatgagggaatccccgcatcgtccaccacactccagatcagttccctgtcagaagcattggaaggacagatttgtgcagtcacaacagtctcctgattttcctcaaacagatgaagccccgcgctgctcttcagcttgatattccgcaccggaatatcttctccggtctgttcttccacctccaccattctgtccatatccgtacaggctgcataggcaagagggctgcggcccggaagggtttcacatttctccacaggtatcagcagctcggtcttcggaagtcccggcgaggatgccattatcttcaattctccgggttctgtccccgctttgatgacagccagaagcctgccgctaaaaagccttttgtctgaggtcttatactcatcctggtctgtactgtccccgttgtccatgccggccatcactccgggtccctccaggcaaatcctcactctgttattggcattctccacaggataaccctcatcgtcttccatggatatctccagaaaaagcaaatcctgcccgtccgcttttagcgtccgttcctccggcttcagacatatcctggcagcttcaccaaaagaatgccttaccttttctgccagcactctgccgttctcatcacaggccagggcgcggatttctccttttgcgtagggaagttgccaatgtcctgcaagctgtctgccatgtctgtggtcaatactgaaagtaccctggctttttccatcaaagaacagctccaccaccggagcattggagcaaacacgcacatctataaactgtccgtcattaaaatcccagtacgggaatatatgtaccatgggattcttcttatagtccgtccactctgcctgatatatatagtaggaatctttcggaaaaccagccgtgtcgatctgtccgaaataagaatttctcgtatgatacggcgtgggttcccctatataatcaaatccggaccataagaactgtccgcaggaaaacgcatggtccctctctgcaaggatacagtcctcagaagatctggctccccagctcgttgtggaattgccaagtgcagaacactgctcatcctcgtctgccagcactgactgctgataaggaaaatggtagattccccggctctgtactgtggaagaagtctcgcttccgtaaatcacccagtcaggatgctccttatgatgggcgtcataatatttttccccgtaattataccctgctatcttgatgacatccgcacatttcctggcattttcccagggcatgtagttagacccaagcgtgggacgcccgtttcctttcggatcatgcttctccacttcctccatcaagatcctggtccacttaaggcctttcggcccggtatgggtatcatatatctcattgcctatgctccacagaatgaggctgggatggttcctgtccctgcgcacccagcttgccacatccttctgataccattcgggaaaaaatctggcatagtcatatgttgtcttggaggattcccacatatcaaaggcttccgaaaccaccaaaagtcccatctcatccgccagccccatcacgtctgaagccggcatattatgagtcagacggaccgcatttgcccccatctccttcaggatacggaattttctcctcatagccttggaatgataggcgctccccagacaacccaggtcatgatgttcacagacaccgtttaatttcaccttgcgtccgttgagaagaaatccctggttcggcaaaaactcctttgtgcagaaacccaccgtctgttcctcttcctggagcaatttcccctctgaatacagactgaccttcagacggtaacaccggggattctccacatcccagcattttggatccctgatcctgctcttgaaggtgtatacatatacctgacgctctgcctctttcaaagtcttatgctcctctcctgtaagaggcaaccaccggtctgcgtccttttcctttatctcataccgaagttccaggttctcccccgcagcttccgtctcgacctctgcctcccagaaatcctcttttttcctggcgtgaaaatatactccgtctgacaaaatatggattcggtgaacttttttcagccacacatctctgaagattcctgccccggaataccagcggctgttaggactctgatgatccacagataccttgatttcattctccccttccttcagatatgaggtaatatctatctcaaaagccgaatatccgtatttccactccccggccaacctgtcgttcacatagatcctgctgtccatgtaaataccgtcaaagcggagaaacaccagcatatcctcttcaggctcacatacaaaccgttttctgtaccagcccgtcgcatcttcatacagagcatccgcatgatagatcagccagtcatgaggcagacctaccgggtaaaagtcctcatgccttttcccgatttcctccagccctgtgtgaaggggctgctttgtaaattcccatccgtcattaaataacattcagtcttatcctcctgattctccagtctgttactccaaatcccatacaaaagggcctgcagtcaatccgcttttgttgcacagcagaccttttttcggcgccgaagaccatgcatagcgaatatggtatggcctttcaaccgcttcggcgtatacggttactgttttcccctctgtctttccatatcctctataatatcttccgtcacagcctgccacctcaaattccgaaggagactctccatcccatgtggtaatctcctccccatcctgtgtatcaaaggacaagatcacctgcccattttctactcggtatgcctccggttccggtcctttcgaaacaagagcttccttatagatcatacttcgcacagccagcgaagcgcggaaggctgctgtcttcttgtcgagcggatgcagatcattttcctcacctatgtccagatttaccgttaccgctgtcaggggaagtcttccagcctgtctctgcgcttcccgtatgacaggccaggcctctcctcctgcaatatccaccccgcagcccggaagttgcacgatcacaaagggcagttcttcctgtctccactgccttcgccagtcctctatcatatccgccagcagctctctgtagaccttcggatggcagtcgttagactccccctgataccagacaactccttttaccatataaggcagacagggggacaccatactatgaaacagtcccgtcggccctctgtttaggaaaacctgctccggcgccggttccaggaccgccctgatctgatactcccactctccgctcaggtcaatccgctccccgggctcctctttcatgtcaccgcctcggatatatctgccgggtataagatcataaggctttccgggggtgactctcccttttccgtttctgcacacaagacggactgcgatctcattttcccctgttcttaacaagccttccgggataggataccgtctgggcggatagcagtattccgtctctcctaccaggacaccgtttatatatatcctgtcactgtccgtcatagttccgaaccggagaagacattctcttccttcccattcttttgacgcctgaaaccgcctccgcagccagatacatccgcagaaatccttaagcgcctgatcccagcagctctcctcctccaaatacgcgggaagcacgatctttttccagacatcatgctctccctcctgctcttttctgaggattttttcctgccacgccttttcttcctcttcctgctgtccggccgccaggcagagacagccgtccttctgatattgctctctgagccttaggtatccgggatgtctggccagccccgcctcactcatccacgcctcaacaggggttccgcccaggctgagatttatgattcccacaggcatcctccgggcttcctgaatgtattttccgaagaaataagaaaaagcagacgcttcgtccagactatccgttgtacatatctgccagcctgcccggacatggtccttaaggggcccagaaaaatcatatttttcttcaaccttatacagatgcacctcgggcgcgcccccgttttcatactcttccggaaaccttgcccgtactcttctcatgggaagctccatgttggactgtccggcacagacatacacgtctcccacataaattcccccgattctctgctcctccccgtcagaagtcttagcatacagaacatagggcccgccgggtatcaggccttttatcaggatttcaaagtttccccagtcatccgacaccgtcctctctctgtgccggtccagccgcagactcacttcagtgcccggacggcaccagccccatatcctggtctcttctccctgctgcagcacacaacccgcagaaaacagccgcggaaatctcaattggcctgccatacacagcccccttcctagaaaccttttcccagagcaattttcaaacgcgctctggcggttattgccagcaggtctgcgcagtaagtgcacagacctgaataggtacataatattatcaattgttctgaatttctgcctaaatcttgccttctcttgtgcatttcttgcgaaaaaaagagtccggcttgccggactctcagaaaatcatttacaatttgccaactccgctacccgcttattcctaaactcgctgggcgagcagtcattgacggatttgaacgtccggttaaatgcgctcagggaagaaaaaccggagttcatggctatatcggtgacactcatctgtgtagagtaaagcagcccctcggcacatttcactctcttggcattcagatactcataaaaagtcatatccatatactgcttaaagatacgggtaaaatggaacttggaaaaaccgcagacagccgctgtttcctccagtgttatgttctcctggtaatgtgcattaatatggttacaggcccgcatgatcgtttccaggtactccttctgcctggcccggtccgccatctcgccactctccatggcgcggtccgtaaaatcccgtcctaattttacaaaaatttcaagcagcgccgcataaatgactatctcacagaatgtcttcttctcatcatattctcttatgattttcttcattctctggtatacataggggtaaagctctggttcgctcttctctgtaaagagaataatctccggaagcaaagacagcaaagtctccatgcctttgagattgtagagaaggagtgggtcaaactgaagaatgatcctctcccccgcaagcggcgcctccagagcgtgaagcacccctgagtttatgatgataatatcaccccggcccagatgatatcgttttcctccgacaatgattgtataatccaaagtcaaaggcataatgatctcaattcccgtatgccaatgctccggatagtcttcatactcaacattatggtacatccgcacacccagtgaatcgccgtaattgatggtttcatgcagtccgtccagtatttcaatcatatctcttcccgccttattccctgccatgccaaacagattttttgacaataatttctcttttataattttattctctgctattgtaaaagtcaagttttttgctctttatgcgggaacaagaggggagattctaaccggacgtcatgcgggcatgactgtgcgcttgaaagcgggagttgttaaattctttggcttgaacgggcaggaaaaaacagacatcccatcacgcattggaatgtctgtttttcttctatttcaaatttaaaggtatgtacagtattatagtaaaatgtatgaataattgatattgattcacttaatttttttaactttttcaataccgtatttattgctaaatatataaactggaacatgaaaagccaatgcttcataaagaactgttgagttcacccatactaagccaaaatagctatatttttttctaatctagcctccacttaaactcctattgtctcaagctatacattggcagcttgtctaaacttcaacgagcataactcgtaaatattgataatggaataactgccatgtattgaatattgatatccagacggtctattatatcaccgtttgacacatcttcggccttataggacaatggctgaaaggcacccaatcccaccggatattccaattctttggtaaaagacttaaaaattggtattagctgacgctgacagccccctcttatttgtgcgcccgtcgggcgtacgttttaacgggtgaaagttccaaatccgcctgtcagtgggaaggatgttcttgcaggcatcctacgtccaatacagtacttccagagccaaaatcctacatgatacgaaggagcatctccccggttcctacattatatccgctggctgcataaatgccgtttagcctgccatctgtcacaaagatcataggtagtttctcatggtctacgtaaaggcgtcttccgagcatgtttacattatgtgtgaaatcatcataaagtacacggattgcaggaaatatttcaagtactctggaaatcagagagtcattaagggcttcctccgtacgcaccgcaaaataaatcctggctgcataaattgcaaattcctctttctgttccagcatctcatttaaaatatgctctgtaggttcccttccttcttccaggaacatgaagatatgttttccgtcttctgtaagaacagacgcagccacatcttccccttcccttgtatgcagctcaaaatcagggatgtcaatactttccagcatatcagcaaggtctgcatagcgcagcttcaattctatggatttttcttctttactctttaggcctaactttctctcatagacaaagacattaccgttgggcagacggttagaagtaagaatcctgtaatctccctcttcaagcttaagcacaatccgtcccatctcccatgttacatttgtcagatcaagggaagtatacacaccgcctgtcagtctggcaatactccagttctggaaatatttccagttctgtacctctcctgctgtaagtgtaagcctgcatgttttctctgctgcttcaatcacaggcacaaaaaccccatctttcataaattccatggaaaaatcattcggattgagccgtgcagggattccaagcgttctggccattgccacgaaaagcactttctgggacagtctgcttcccacaccgaatttcaggcatgctgcgggggtggtaacaatggtatccctttcttcttccgatcttgctttgactctcttcgttatgactctccagatttctcttgggtttttcttcaggttttctttctcctgacatgagaaagtatccaaaatttcttttctgtattttgtcagcacttcatgggcaattcttggatttaacacatacggaacgaaaatttcttttggaaggctgtctttctccgccagcttcagaccgtattccagatgttcctcaagtacctctgccctgcaatctgtctggtctttttccgaaagcacttccacaagggcttttctccacttaaccgtatccttctccccctgaagaaaacttgtccgctctgtattttcccagttctctcttttgtaccgcagcttatctgctgcttcttttaatcgtctgttaccttcttctgtctgctcttttgcaggcatatccgtgttcaccggcatatccacgggagcgatcatgtcacgcaccgcccactcttctgctttctcttccatctcaagaaagtcttccctaagaacaatcgtacaggtgtcttcattccttacatcgatccagccttcgccaaggctccttccatctgcacccccttcttttttcacaaagatgtgcaggcttccaagacctgtgctcagcctgtgccggccctgctcgtccgtgattccttctgcaataggaacatattcggaataattgatcacctcgaaatacacacaggcgtcctttatcggcgcacaggaagaatcttgcacacagacagtaatttcttttgctgcggcgtaacgtttcagttcgttgagcatggttaccataccctctttcccgataacttccccttccggcactttagcatcaaaaatcctggaatgtaccatcatagctcttgaagacgcatggatgaaccatccctggttcagaatcggcagcggttcgcaggcgcctgtaaaataccaggtaccgtcacaccatacttccacccatgcatgattgtcatcacaatgggaccatctcggtacatagacctgacgggcaggaatgcctgcgcttctaagcacatttaccataaaggcagattcctcaccgcatctgccgtatcctctgttgtacacagtcatagccggcagagtcctctcatctcctgcgtgataagtcacttcttctgcacaccagtaattcagttccagtatctcttctttcccgcaaagaccttttactctgtctttgatcttgtcataaaagaagctgcggcacggaatcacctcttcgtcatttactctgtgaaacagcacataattcaggaaaatatcctccggaatggccctcactgcttctttttcctcccacagacggactccgtggacagcaaagtcaagaaatgcctctgcatgataattgatcatatcactcaaaggcatggctccatacaggtatttcattgcaagtgccgcattgtcactgcaattttccagcaccttctctatctgttcccggatgtatggagatttctctttacgttttgcataaatttccagaatacgcggcttattctctgccaaaaaaacagtctgttctcccattataattcctccaatacctgtcttgcctggcatattttcgcttcctctgtgcgccagatttcatatttgccgattgacggaggtcccatattgaccccctccttccgataatccatggaactgtccagggtgaccttgccagacatgtgataagcagttgcatttgtaagagggtagatttccctgatcactgccgcatccacaccgcttcctgcctgaatccgaattcttcccgcacttttctctaccagttcacgaagcagttcggttccctgagagcacacattcttctgacctgatgtcaatatagtatcaaatcccagttcaatggcttcttccatggcttcataaggatccacacatacatcaaacgccctgtgaagagtcatggacatgtcccctgcctcttccataagctcttcaagctgttccttattcaaagtgccgtccggtcttaagattcccactactgctccgtcagctcccaattcgcggaacattttcacttcctcttttataatcaaaaattcctcatctgtatagcagaaatctccaaatctaggccttatcaacacatgaatcttaatgtctgtatgttttcgtatctccttaaacaggcagggactgggcgtcgttcctccgattatgagattcgcacacagttccagtctggtcgcacctccttttgcggctgccacagcagactctacagaatccacgcatgcctccagtatgtatccttccatcctacattccccccttgcagcagagctgatagatcgaggtcactcctgcacctgtagcaccctgtgactgaaattcaaatacagggctgtccacccatgccgttcccgcaatatccacatgaatccagggacgtccttctgcaaaagcacggataaataatcccgctgtaatggtgccgcaaaagttctctcccatatttcggatatctgctaccttgctctctatcatcttttcatgttctttataataaggcagcctccaatacctttcaccggaagctgcgctcccgttggcaaattcttcataaaactcatcattgtcggaaatgacaccgcctatgctgaatcccagcatattcacgactgcgcctgtcagagtggcgatatcaaggattcggcttaccttttcttctttcactgcataagaaaccgcatcagccagaatcaggcgtccctctgcgtccgtattggcaatttcaatggtctttcctgaataagatccgatcacatctccgggcagaagacttcccggagaaatgcggttttcacacatcggtacaactgccgtcacatttgtcttcaccttattcttagccagagcaaagaccgcaccacaaactgccgcaccgcctgccatatctcccttgatccccagcatggaacctgccggtttcaggcagtaaccgcctgtatcgcaggtaacgccctttcctataagtcccataaccccgctgctttcatggtttcctttataacgaagcaccagcatacacggcttatattcactgctgtttcctactgcaagaagggcttccatgcccatctctctcaatctgtctacttttatgatttccgcttctgcatcggttcctcttgtaaatgcttcgatttccctggctaaattctcaggacggagtttatttcccggcaggttcaccatatcccttgcaaagcagactccctcacataggacctccgtctcctttaccagaatttttgcttcttcttcccattcatggggaataccgaaaaattcgatttctgctgcttctctttccttttctgctttatccaaagagaacctcttctgcgtatatgcgccgagcactgcgccctctgtcagatcacgcactgcctctacgccatattcacagagaatgtgacctatatccatggaaatcccatttatctttttacttctgcattccttcactgcttttgccgcaatctctttcctgcatagtttgtcttcctcggtttttccgatccctgtaagaagcagcagttttccctcttcatcgcacatccacgctgtcttaagatattctcccttaaaaaaagatcgtattcccttcggcagcgtctccaagcgctcatcctcttctttgaaaaaagaaaccaatacattttttgtaccttttgaaacaatctgaatcatctttcctccctgattctgcctatatcaatctgactcccgcactttccagtgcatcgacgatactcttgtcaggatactcatccgtcacgattccgctcacatcatccagatgtgcaaatttataggattcattaaaataaaatttctccctctccatcaccacgtacttatgccggccgttctgtatcgctgccttcttcgtaagtccgtcctccgcaccgagcgtggtaatggttccatccaccatatcgattccacagcttcctataaaaacccgatcaaagctgtactgcctgatcacctcaatggctgcaatccccatgaacccatttactccctgatacatggtccctcctgtgccgatggctgtgatacgcggattctttgccagtatctgaagaatgtcgatcatattgctgactgccacgacacgcttgctctggctggcaagaagtttcgccagttccatattcgtggtggaaatatccagaaataccgtttctccctccttgatcagttcaaacgctttccgggcaatcacccgtttcttatccacatgataattcttccggtcaacaacatctctttcaaggggataatcctgtgacaggattgcccctccataggtacgtttcaattttcccgcattttccagggcttttaaatccttacggatacagtcttccgtcacatggaactgttcacttaattctttcacacgtaccttgcccttttcctgaagcgcacgtgtgatcgcgtccagtctttcttctgtaaacataaactatccccttttttgtttattattctgttactgcttctatgtcactttcatactgcttatatctcatttatatgttacgttcgtgtcatttcaacactacatccaagactgtatctacagcatccaaaagcaccgggtcggggccaagatttgcaaatacgatatccgggtaatcgctgtgcacccaactgtcggagattggaatctccgcccctgtcgccagatagcggatgccttttacctcttcttttttgaatccttgaagagggacaggccctatggtattttcatatatatgaaaatacagatgatttccctttctggtcacacggccgaaatccggtttttcaatccctgctttgctgcatccgtagatgctttctttgtttttcttcatccatcttccaatctcatagagtatttccatagattctataggaatatttccttttgcatccggtcctacgttaagaagcatattgcctccttttgatacacattctaccagtttttttatgagcatggaagcgggtttgaaataatggtcttctgcacagtaaccccagttgttgttcatagtcacacaggattcccatacaaggtcttccccgttcacatcctgaatgccgtttggaggtatcatctgctcaggacttacaaaatccccgtggtaaggcatcggattccccgaagccagtgaaccgtatccctctccgcttacttcaaggcggttgtcaatgatcacttccggctggaggctgcgtaccatatccacaagctctgtcgccctccatttttctccccgcatgtcatcataagagaaatcgaaccacaggatatccaattttccataattggtgcagatttctctcacctgattatgcatatatgtgagataattgtcgaaatttctgttctcattggtataggctttgttgtttcgcatggggtgattcttgtccccataatgaggataatcttcatgataccagtcaagcaaagtgaaatacaatcccactctcagcccttctccccgtacagcctccacaaattccaatacaaaatccctgccgcactttgtattggttgacttaaaatctgtgtacttgctgtcaaagaggcagaatccgtcatgatgcttcgccgtaagaaccacgtatttcattcctgcatctcttgctgcctttgcccaggctttcgcatcgaagtccacgggattaaactcccggaagtatttcatatactcttctttcggcaattcctccacacttcgaatccactcgccccttgcaggaatggcatacagcccccaatgaataaacataccaaatctggcgtccttataccactccatacgtttatcatattctgtcctgtcaaatctgtacatcacattctcctttttcacaagcccacccggaccagatctattcgcatttgctgcatgctacaaaatgtcccggcttcacttcttttaagaccggctggctctttttgcagtcactgccgtactgattacagcgggaagcaaatttacattcttctccgagattaatcggattcggaaggcttccttccagcattatacgctgacggttcttctcaatcttcggatccggaatcgggattgcagaaagcaatgcctttgtgtacggatgaatgggattcctgaacaactcttcactgtctgccagttcgactaaggagccaagatacataacaccaattctgttactgatatgttttaccatggacaggtcgtgagcaataaagagataggtgaatttccgcttactctgaagctcttccagcagattgactacctgcgcctgaatggaaacatcaagggctgaaattggttcatcacacacgataaaatctggattcagtgccagcgcacgggcaattccgactctctggcgctgtccgcctgagaactcatgcggaaaacggtctgcatgttctgcgtgaagacccactgtctcgagaaggtctattaccatctctgccctttcttttttgctggaagcaagatgatgggcatcgattccctctgccacaatatcaaggatttttcttctcggattcagggatgcatagggatcctgaaagatcatctgcattcttctcgaaagatcatgtctttgctttaagtccatggatttatcaatgtggatgccgtcaaaagtcacagtacctgctgtgggctcatacagatggatcaccgttcttccgaaggtagattttccgcagccggattctcctacaagccccagggtttcccctctgtaaatctgtaaggtcacatcatctactgccttcaaggtctgtttatttcccacctgaaaatatttcttcagattctttacgtccagcaaaatctctttttcgttattcttcatctgtactcacccccctctttgcccgctcatcaagaagccagcaagctgatttatggttttcgccgcattcataatattccggcatataattctggcataccaccaaagtctctttgcatcttgctgcaaagggacaacccttcggcggctccataagatcaggcggcgttccgggtatagcctttaattcatggcctttttcctgtgcctttggaatagattccagaagaccttttgtatattcatgtttcgggttatggaagatatcttccacattcgcagtctctgccagctttccgccgtacataactgccactctgtctgctacatttgccacaacaccgaggttgtgtgtgatgataatgatggatgtcttaatcttcttctgaagctctctcatcaaatcaagtatctgcgactgaatggtaacgtcaagggctgttgtcggttcatctgcaatcagaacctttgggtcacatgccagtgcgattgcgattactaccctctggcgcataccacctgagagctgatggggatactgtttgtatcttgcttccggattggagatgcccacaagagccagaagttcggctgcacgtgtctttcgctgctctgcgctcatatcttttttgtgttccttgagcatttcttcaatctgttgacccactttcatagtggggttcagggaagtcatgggatcctgaaaaatcatggcaatgtcagaaccgcgaaccgcctgcatctgacgctccgtatattttgtcaggtcatttcccccaaacattacatttccgtccacgatcttggcgttctttggcagtatccccataacacctttcatagtgatggattttcctgaaccggactctcctactactgccagagtttcctgctcattcagataaaagctcaccccccgcactgcctggacaatacctttatgtgtcttgatatgtatcgtaagattgtttacttctaatacttttcccatattctcacctactttctcatctgcgggtcaagtgcatcacgcagaccatcgcccagaatactgaaacataccatgatcaggacaataaccatggcagggaataccagcacatgagtataattacgaagtacctgataaccgctgttaatcaatacgccaagggaagcctgaggctctgcaagtccgataccgataaagcttaagaatgcttctgtaaagatagcatttggaatcgtgaacattacgttgatagcgattacactaactgtattcggaatcaaatcctttaaaataatctggaatttgctggttcccagcgtctgtgacgcaagcacaaactcttgatttttcagcttcaggatttccgcccttacaaggcgcgccatatttacccaccctgtaatggaaagagctgctataatagttcccacgcctgccgggaatgccataagaaacaggataacaataatcagatgaggaatgcctacaagaatctcgatgattcgctgcatgaccacatccaccttacctcccataagagcggacaccgcaccgtaaagcacgcctaccacaagatcaagaactgctgccacaagagcaatcataagggagattctggttcccatccaggtacgaacccacaaatcccttccaaattggtctgttccgaagatgtgtgcagcattcggagcaccgtaactattttcataatctgtggcactgaaggaatactggctgaaaatgggagcgaaaaccgccagcaggatgatggccattaaaataaacaatgcaacaaccgctgctttattttttctaagccttacccaggcatctgccagcacagtagaggcaggagcagctatatgttctttctcagatgcagatactttggccttttgaaacatggaaatatcaatatccgatttgttcatgattcgttctccttcccttttgccaatctgattcttgggtcaatgacagaataaaccaggtcaatcagcagcactacaagcatgtagaacgctgcatagaaaatcgtgattcccataatgacaggataatcgtttgcttttatacaatctacgaaaagacttccgattcccggaatactaaagatattttcaactgccagtgaacctgtcatcagatttactactacaggtccgagtattgtcacaacaggaagtacggaattacgtactgcatggcgcataagcactttcatctggctaatcccttttgcacgtgctgtcacaatgtagtcctggtcaagtacgtcaagcatctctgtacgcatgaatctcgctaccatagccgtagcactgaaggacagggcgattgagggcagtaccgaacaatcccagtttgtccagaatcctacagggaggattccccatttcaatcctataaaatactgtaaaagagccgctgcgacaaagttcggcacagacactcccaaaaccgcaagtatcatggtaaaataatcgattccgctgttatgtttccatgcagccaggattccaagaatcagaccgactgcaagtccaagaagcactgcctgtataccaatgagagcagaaggtccaagacggccggaaattacatcagccacatctttattcacataggtaaaagacgttcccaaatctccgtgtatcatatttttcatatatttcacgtactgcaccggcaaggggtcattcagaccgtacatttccaaaacttgtttctgctgtgcaggagtcatgatactgaatctctctgcatcaaaaggagttcccgggagatttttcatcataaaaaacgtacaggtgacaatgatccacagtgtaaacacaatgtatccaagacgctttgctacatatttcagcattttatcatccctttctctatcagcaaggaacagaaaagccgcatacaggtgtcataactattcactcctgtatgcggccccttcgtcacttaccctttataatttcttattatttatttaaaagaagcatatttgaattcaatcggaacaccaatcgggtgtgtgataagattctgaacatttgattttgtcagcgttgccgaacccctgtgataaaccggtgacactacaacgtcttcttctaccagtttcttctcagcctgaagcatatcctgaaggcgggtagtatcatccgtctgtgattttgcatctgcgatcaggccattgtaggtatcatctgcatagtttcctctgtatggtgtgccgtttgtccacaagtcaaggtatgtcatagcgtcgtcatagtctgcgccccatgctgtgaggcccatctggtaattgttggcatccatcagttctccacgaccctgagccgtcttagtgtcgattaccatcttaagtcccagatttttctccagttcgctctgaaggaaggttgctactgcttttgttacagaatcatctgcaacgagcattgtcacttctgaaggtgcgcttcccagttcttctgctgctttgtcatagtattcttttgctttttcaggatcaaatgaggaaacctctccgttcagttcacggaaggtctttgttccgtctcccgccataccgtctgcgataaggcctgttccaggtgcggaaccgtctgcaaggatgttctttgtaagggctgtcctgtcgattgccatggcaattgctttgcgcatgtttacattccccactaccgggtctgtcaggttgaactggatgtatgtagtcctgaagtcgatttcatttccaaattccgggttatcctggtttgctgtaacgttagaggaatcaagctgtacctgtgacaattctcctgcctggtaggcgctcagggctgccgccgcatcttttactacacgtatttttgcatctgctatctgaacattgtctttatcccagtatttatcattctttgccagagttacgcctacggacgggtcatattctgtgattgtgtaaggtccgctgtacagcatattttccggtgccagtgcgtatttatcgccctgttctgtatagaatttttcatttacagggaagaacataaccattgtagtcaggttgatgaagtatggtgtcgggctttttagggttacctcaaaagtctggtcatctaccgcttttgcgcctacatcttctgcttttgcagtgccttcgctgtattcctttgcatttacgatgtagtcatttatgatgaagctgtatccattcgttgcttctgcgcccatctgtttcagccatgcaaatacaaaatcatttgctgtaatactttccccattgctccaccgtataccttctcttaaatggaaggtatagatgagtttgtcatctgatacttcataggtatcacaaagtgctggctgaggtttgttgtctgcatccatacggaagagaccttcctgtacctgattgtttaccatgaatgcactttcttctgaggcagcccactgaaccagtgtctttacctcggcattggtcgctacgcttaagacttcgccggaggtttctttttctcctgatgcctctccgcctttttctgttgattctgtcttgctgttgtcatctcctgtaaatccggctccgcatcctgtaataggaactactaccagggtcaatgccaacaatgctgccataacacctttctttttcatttgcgctacttcctttcttggttttgttaaatagctttaggttttgctgaaaatattgattttctgcaccgttcctttatctaaatgaagtatatcaggtgtttgtcgctttgtcaattgttttgttctgttttgtattgttttctcgtattcttatagtttttttccttacaactacgatttttacaggataaaactgtaaatattgtcaatattattatttatttcatataatagtaagtttataggattttgtttttattgtttcgtcctgttttaagttttcatacggcttcgtctctgtgcagattcctccgcaaaatatcttattttcattttccacccatatctgctatgattatccgcagataatacgaatggagtaatatatcataactgtatataagacaagaggcatctgttcgcgttccatcgaaatcgagctggacggagatacaatcgcatctgtaaaattcaacgtgggatgtaacagcaatacaaagggaattgccggccttgtagagggaatgagggttgacgaggtcatcgagcgcctgaaaggaaccgactgcggcggacgcggcacatcctgcccggatcaccaaagtgccttccaaaggtccggttcaggcgtgacgcatgacctgtgctgtgtcccatttcgtggatcagggtagcgataaaggatcccgcatccttgaacatgcctctagcctgttttcaggtgatatcctgctttctccatctgcttgaaggtcatccagcggggatcggcatagccgtcttccatcccggccaccatcagatgcagcctgttgctgcctttatagacggatccggtttccgggttgtgtggataaaatgtaagacggctccaggcaggacggttattatggtatccttcctccatcagccggatgactttctctacaagctttttccggctgtccatcaccttttcaaatgctgtcgccatcggctctcctccattcttcatctacagattcatccttgatctccgccatttcctccaggtcatccatatcgatcacccccggctcctctactacgccatattgttctttccactcttcgatattcaccttgctgtctcctttctgctgagcatgagcagtctccgcatctgattcatctgcttcgctgtcagatccgggtcataaaatgtcctaatctcctcatcggtcatcccatcctccagggcctggatgatctcctccatctgctccggatcaaggggataccggttgatccagtcatatgcagtgccaacggatagatcaagtgtggcaccgccttgttcttcttcgatctcccggatccgttcctggctttgctccatgagctcccggatttcttcctcgtccatgggctcctcatcgaaatgcatctgcagaaaactgtcttcatccaggatgatatattgcggactcgcgccggattctttttgtttccggtaatagtcgatctcctcctcttcaaggggttccagggatacctgttccaggtcctgaaagtgcatcccgttcctcacggcacggtcagggagatcatagcagcccagctcaaccgcctttttgtaacgctcacattttcctgtctggtatttcttatacattaccgggttctcccctgctaggaggacaatgcatttttctttgttgaatttatataattactacacctttaaatgatcaccattatttaccggtagtaatatgaccacttcagatattacactatatgcggaggtgaaaagcatggataatgagaagaataagaatagggaatttgatccggattatgaagctaaccctgagtttgaagttgatccggaatacattgaatggatatgccagcgcatgctagaggaagaagactaagatgtcgaaaaacgtctgcgactacatattgcatctctacctattatacattatcattaaaatgtaaccagaggtatggataacctctgattcgacttgttggctggtgctgtaatggtgccggcctttttgtgtctcttgacaactgttgacagtccttttacaatataggcaaaggtaatgacaatgaatagtaggaggtatcaaacgtcatgccggcgcgcgtggactatgctatatacgcagattcagacttatccattttaacaattcgggaacgtgaaattttgatattgaaaatgcaaggtctttcaactgttgaaatatcaaaaaagttaaattgttgcagacaaaatataaatgctttgcttttgaaagcacgtaaaaagcttgataacccacaaacaaatcctaatatacatcgtaggcaaaatattgactatacccaatatgcagactgtgacttatctatattgagtaggcttgaacgtatcttcttgtcagaaaaaatttctggcaaatcatataaggaaattgcagaacaacatcattccacgataacctctgtcggaactttgttgtatcgagcgcacaaaaaactagataatttttatgattaaaggggctgtcgggaaatagatagtcccagaaaggggccggtgtgactcaaacgagttacaccggcccctgaaatatttcctcaaagagaaaaaagatggctaacaacaaccatctttctctccgttccatgttataatggaactatgcaaaaacaagattattataacaacttttttgaaattgggcaacagaaaattaacttcagtttcttcgaattgagtctactcgacgacgatccagtctataccctgaaaaaagtattggaggaattagatttttcaggcctgctggcctgttattcagataagggaagaaccgggtttaacccaatcatgctgtattctgtggttacctacgcaaacatgcgcggggtaagagctgttgaccgtattgtagacttatgccagagagatcttgcttttatctggctgaccaaagggcagaagccccagcgggatgttttttacgattttaaaggaaaaaagctgacgggagaagtcctggatgaactgaattaccagttcatgcgccgcctggagaaggaaggccttatcacactgaaagagctttacattgacggaaccaagcttgaagcgaacgcaaacagatacacgttcgtctggcgtggaagcctcaactatcaccttgccggcctgctggatgccatcgatgccctttatgcaaagtacaacgcattcctgtcggagaatggatatgggacgaaatacgatctcggggatgcccgtatgttcgtgatcgaaggaatggacaaagtcaggaaggtcatcgaagaaaacaggaaaaggaaactgacaaagcataaaaagatctccaataacaccctcattgagatcgaccactgttctccccttgagatcctgaagctgcagaaaaacctgatgtggattgcgcaaagggaagggatcgaattcgttttcggaaaagggaaacataagccagagatccagaaactccatgaggaactggaagaatgcggaaagcgcctgatggggtataaggaatgctttgagaacatgggaaaagaccggaacagctattccaagacggacctggaagcaaccttcatgcggatgaaagaggatcatatgcggaacgggcagctaaagccggcatacaatgtccagatcgcggtagagaattactttatagtccacggatatgtgagtaatgacaggacagactatcatacgctgatccccgttttgaaaaagcaccagaatgcgtttggagatactctggaggcagtgactgccgacagcggctactgcagtgaaaagaatctgctgtatctcaaagagaacgggatccgaagctatatcaagcttcaggatcatgagaagcggaaaacccgggcttataaggaagatatcgggaagtattacaacatgacatgcgccgtctttgaggatgagcgttattacatctgccatgacggaagagagctgcgccatatccggacggaaagaaaagagcaggaggattatatccagacggtagaggtatatggctgtgcggactgcagcggctgtgagcatagatccaaatgtctttataaatacaattcccaaaagaatccagaccggaataaagtcatgaagatcaacgaacgctgggaagaactgcgggaaggatccaacacaaatatccagagtgaggaagggattttgaaacgtcagatccgttcgatccagacagaaggacactttggagatatcaaggaaaacgaaagcttccggcggttcaactaccggtcagaggagaaagtatataaagagttcatgctgtatgcgatcggacggaacatcatgaaataccatcggttcttacatcatgaaatcgaaaagtacgaagggaaaaaggagcagaaagcagcttagctgaagatgtgcttcaaaaaatccagacaagggggttttgcgccctaaaatagaagctgcaaaaaggaggagacaatcccatagagaattccggcttaaaaaaagcccggattctatgggattggacggtgtgaaattttttctgtaaattcagatcttctatgataatagatgcggcttgacagcagttttctgctgttgagccgttgtttatttaatagcaaaaataagctggcatgtcaagaccgcccagaaaaatctgggcgtatatttactcttgatattccagcttttttactatatcagcatcctgtctggaaacataatctctaattcaccacgaacttttccccagtttctgattggcattgtccacttttttgcaatctcgaaagtactcaggtatagtgctttcatcagcgcttgtgagcttgggaagacgctgcgctgtttattcagcctacgatagcaggaattcaatgattcaatggcatttgtggtataaaatgcggtacgtacgtctttagaaaacttgtagattggagatatcgcgtcccaattctcacgccagcgattcatggcgcttgggtattgatcagaccatttcttggttacagcctctaactgctttctggcagcctcctcatccgctgcggtgtagattgtttttaaatcctttgcgaatgctttcatatccttgtttgcaacgtatttaagcgtatttctcaccatatgtacgatgcaacgctgctgttctgttttagggaatgccgcagagattgcatcctttattccgctcaacccgtctgagcagagaatgagaatatcctggactccgcgattcttcaggctgttcaatatagacagccagtacttactgttttcattttcgcccacgacaatgcttaggacttctttcatgccgtcttcattgatgccaagtaccacgtatgctgccagctttctgattaccccatcatcgcgtacagagaaatgtacagcatcaatgaaaacgattgggtatacaggtgacaacggacgattctgccattcctcaattcttgggagaagcttatctgtgatatcggataccatgccttcacttacttcaaaaccataaatatcctctatggtctctgaaatctgtcgtgtggtcatcccctttgcatacattgcaataatcttgtcatcaattgaagaaatatctttttgacgctttggaagcacttgcggttcaaaggaactctggcgatcctgaggcacatctacctcaaattcaccgtatttactacgaactgtcttaggctttgtaccattgcggtagttaggctcaccagatctttcatagcgatcataaccaagatgattatccatttccgtttcaagcatatcttgaattgttttggaaagcagatcttttagtgcatcctgaatatcctctgcagattggatatcgtactcctggagcagtccctggataagatttctttttccttcggtcattggttttggtttgtaaacttctttttttctgtttgccataataaaaggcctcctatgattttaatattttatcatagaagacctttgtattgtctaatttacagaaattttttcacaggctctgggattgtctcctcactggctgtcagaggttaaaaatcggtattaaccgacaacccctttagacaaaaatttaaaaacactttcaaattacaatattgtaatatttatgatgcattactgtatcgacatagataaagctccctgtgtaaatacacgtaaatctttattcaaaaaatacaacatttcctatgtcacttgacactttcagtccttctataatttttattgaatctaaagagcttgttccatttgcaagaggatatcctccattttctatgcagtctattatgttcaaaatagcttctatcattctttcattttcgttttctttgtttacagtttttattaatttcaatgaatcataatttgctcctgcactatttatttcgttagaatattggtataaatcatatgttaaaccattattgtataattttattcttcctttttcccctaatatatccaactcaagcatatattttgatggggaactgctaacaccttttatgaaacccataattcctgtttcaaattttatcaatccaattccaccataatctttaacattatgagccattcttacaaagtctttttgcttttcgccgattacccaaataggatttgaatttgaaaaataaaccattaaatcaattaaatgacttgtactggtatgtaaagctgtagccccatatcctaccatcgtatatattttgcctattgcattattctcaatcaaattctttatttccaaattcaagttgtcccaacgtaaaatataattcactcctaaaaccacattactttctctacacaacttttcaatctcttcggcatcttttaaagaataggaaagtgtcttctcacaaaaaatagctttaacacctgtttcgacacatttttttataatttcataatgtgtttgaataggcgtacatatactgacaatatcaaagttgttttcttctagcatcttattataatccgtgtaccttgatcctattccacattcttttcctatttcatcaactagattttcattaacatcacaaatagaagctatttgggtaacgtcaatattctggtatgctttgatatggctccaaataatttttctatattggatctttatcaatataatacgcaatttgtcctaatcctattatccctactttatacattttctcttatctccttttcccttaaagcaaaaacacagccgaaaatgacaaccatagcgcctattccttgaataatattaattttttctcccaacgtaaaatatccaactattgctgttgatagcggaacaatgagctgtaaaatattaaataccacaactccttgtttctgaacaatgtaaaaagccatcagcatccccgtaagcataccgtaaattcctgccaatgccagccctaatagtaatccgccactgacttcagataactgtactacttttccggttcgaatggctattgctaaatacataatccctgataatgtagcagtagatgcactgattacaatagaatgtaattttttactgacattttttactactaaattttgaatggactggataaatattgcagttcctaaaagtaaagaacctttaaaaaaatcactgcttcctccaactttattcccataaataacaaaaagtaaagaacccgctatagctaaagcactaccaatataaaaattttttttctttattctgcctctttcgtctttaaaaaagatagctgccataataacagctaaaggcatagcaagtattccaaaaatacttcctgttaatgcagatgtatactttaatccattcataaaaaaatacatatttccggtcataagaacacccagtaataataactttataattaaaacaggttctttctttatcttcttaaattcacccctgaatttaaaaacacaaattaatatgaacaaaaagcctcccgccaaaaacctaaccgcattattgttaacggtttcaaaattaatgctcataaatctcataatgggaagtccaaatcccattaaaacaatataaaaaattctgataatataatcattattcattcgataacctccttaaaagctccatattgttgtatctcaaaaaagttatttgtaagactccaaatacaagaattaaaatctatattacttttgcccgtaaaaaattacagaccctatcaatatcagtctctttttcctttaatgcctctatatatttcgttaccgtctcctttctttcttgtatctccatatcagacaatcatcgtacatttttctggttgccagctttgctatgtagccttcataatgtttcattaccatattgattgccatagtaatctccattccgccgctttgcggcggcacaaatagtgatgaaagtgattcacactttcaagttttcgtgctacaatagacttgattttataaggcattcccggcatcagtatcagatgcacccacccgttttgctattgatgtgcaggtgcgcctctttatctaggtgggaatactcttaatttggttcactatgtgagcctgttttttgtgtctatttcacgattttggcttgatttactttctttcacagtattacctgctgttgcatcctcaataatgcaaaatggaaacagccatttttcttctgtatttttattttttacactcacttttgttttcctccattacctgcttcaacaattccaatgaacgcgtccggtgttcatgtaccgtactcctgacaagattcattttccttgcaatcgcagtatcgctcatctccataaaatatgacagcagaattacttctctttttctatctgtcagtgcatttaatgcttctgccagtaaagagccttttacttttacatcatactcacacgctttaaaaaaataggatgtttcattatattcatccaacgccagtttgcactttcgagcaaactgatgtctgaccgttgtttcgtcataggaagaagattgctccatagaattcacctccttcccgaccacaagatatgagcaaaggccttttccctttcacccatatcccgtatggaaagtacccgatgttcgggtctggaagaatttttttatttttatgtagaaactcttttctatttttgtctgcggcaacatcctctgaaaaatattctaatcttgtatacccttcatttgtcgaaatcatctggtttctcctctctgtatatatattaattataaataaaaaatcatttctttgaaacagagtgaacgctcaaaaatagcattatacgcttattttatttcttgttttaccatttatatagcataaatctcaattttcgaattcacgagcctggctatatattcgagaaacatttaccgcaatattgctctccttttataaaaagatagtattacaaaaatgaggcggtcttttcacataaccacctcatatacataatataatctttccttataatgcttctaacgctttgttcgatcccactagaatcagaaccatatcttcgcgcaacacttcagaaggatctggattgacctccacatgtgccccacttttaattcctactacattcacttcatagctctggcgcacatccagttctttcaaagtttttccactccattttgcaggcattggcgtctctacaatgctataatctggagacaatgcgatccagtctgtaaaactggcagacatcagattcttcgccatacggactcccatttccttttccgggaaaataatagaatctgcgccgttttttttcaatactgttgcatgacgctcatttttagcttttgcaatcacattcggcactccgatttccttacacaccaatgtggccatgatacttgcttccagactttctgcttctgcaattacaacgccatccagatttcttgttccaagagatctgataaactccgaatctccgatgtcggcctgcatcgcatacgacactgaatccgcaattccttttacccgctccatgtctttatcaactgcaacctcctcacatccgagcttctgtaattctaacgcaatactttcaccaaaactgcctaaaccaaataccgcatattgtttcttcatgtcttttcctccctagtataataatggtgtagtcaagaatgactactggttaatagttacaaagtccaatctaataaatctctatatataacgtaaggaggagttccccctccatcagaagttataaggcaacattatttaccatgtctgaggtttccttcatgcaccagacaaaatatagaggtataatcactgaaggcaggatcattgacgtttcctccttgggaaccggcctcccggctggtgaaacctcttagaaagtctgtcagtccattcggtggtgatttatgttttggctggttgggaagccccaggctatacctgtataagccgctaggttgtgtatccgccttctggaaatggatacctgccggaaaggataaaacaatgcactatcaaaaagcactcaagatgctcgaaagcatcccatacctctcagtcgggcttgatgtcggcgcagatttcacatggatgtccatcatgctccccaatggcattctcactggtaaaccatttaagatcattcactctgatccacagtcccgtgagcttgccgtcacaaaaataaaggaagcacaagagatgtattctctcgaaagccgctgcttccttgagtccaccgggatataccacatcccgctcctgtacttccttcgtgataaggggtttgactgctcggtcattaatcctatcatcactaagaatagcacaaatatgaacgtaaggaaactgcataatgataaatttgattcaaaaaaagcggcgaaggttggtctggatgtctcccttaagacttccattgtcccggacgacactatcattgacctgcgcaacctcgtgcgtgactactattatttcaaggatctgcagtccgccgtcgtgttgaagcttaatgccgaactcaaagtgtccttccccgcatacctgaaggtattcagcaagatcacaacgcagacttccttaaaacttctggaagcttatccccttgcagcggacatgcttgccgccccaaaagacgagcttgtgaaaatcatccgcagcacggcacgctttggggaaaagtatgcccttgccaagtatgattccatatgcaccgccgcaaaggatgccgctgttttcggacgtgcacttccaagtaacgcgctccggatccggctgtatatcaaaacctaccgggaataccaagagcatctggacagcgtactcgaagaactgcataaggctgttaataatctggaaggaacacccgtctatgaccgtatcctccttctccagtccctgtggggtgtcggcttcctcagtgcggttgtcctgatcgctgaaatgggctcctttgacctgttttcttcccctaagaagctttatgcctactttggtctggatcctgctgtaaagcagtccggcaaattcaatggggacaaagtccacatgtccaagagaggttccagccttgccaggcgtatcctgcatatggtagcgctcaataaccttaaggtggataaagggacaaaaacaccagtaaatccggttatccacagctactatgccaacaaatgcaaaagcaagaagaaaaacgtggctgtcggggctgtcatgcataaaatctgcaacatcatttttgccatgctccgggataataagctgtttcagatcatcactcctcaggaactctgtaagcagtatctggcagcgcatcctgacaaggcacggaatgcagcttaaccagttctcataaatttttaagtttccacatgggtgggcttattaaagttaccctttttttcgtcaactgcttgaaaaaacttttttaacatttttcattttacctattgacatttcttagctggacttgttaaccgatcataatcttttctgttggaagtgtccgcatcttttcctgcaggttcacctttcctgcgaataataatgcaatcgtcatcggtccgacacgtcctatatacatcaatatcatcagcacaatcttacttcctatccgcaaatgtattgtcaaatcttgtgacaatccaacggttgccatcgcagatgcagtctcatacataatccgctgaaaagagatggaatctggttctatcactgcaataatcgttgttcctgttatgtatacgcctagtgccagcataatttccacgaaagccacatgaaaattttcttcatccacttttcttctaaaacattcgatatcatgtcccccacgaagcatcgtatgaaaagccagaaataaaagggcaaaagttgttgtcttaaggccacctgcagttcctcccggagaacctccgataaacattagaatgatattcagaaagctggtctcttcatgcatcccggactgttgaaatgtactaaagccggccgtcctggttgttacagactgaaatgccgaagccatcatcttttgcccaatattcagatgcccaattgttgccggattatgatactccaacgcaaagttcaaaagtgtccctactatcagcaaggctaatgacgtaacaatcgcaatcttagaatgcaacttaagtctgataaaccaccacttctttggaatttcccgatgccagatctttttcccattatcaattacgtcataccataccgtaaaaccaattccaccaaggataatcaaaatcatcgttgtaatattaatcaatggatttgttgcgtatcttgccaggctgtcatcaccgaggatatcaattcctgcattgcaaaatgcagaaatcgaatgaaaaattccataccagattccttttgtgattccataatcctgaatgagctggatcgcataaaaagcggcaccgattccttctatcactactgttccaattagaatcttacggaccatgcctaccagaccgccaagagaatccatattataagcttcttgaattacaattctctcttttactgtaatttttcttttaagcagcatgaaaaatgcggtgatgcatgcaatgactcctaaccctccaatctggattagaattaataaaattatctttcctatcattgtaaattggtattttggaacaatggtaaccaatcctgtcacacataccgatgatgttgatgtaaacaatgcatccaggaagctgattggctttttattagatatcggtagccataaaagcaccgctccaagaaaaattacactcagaaaaccaattaccagaatcttcatggtattccatctgatattttgctttctctttttcttcattttatatttcgcctttcttgtctgttctttgtcttctataatgactagcttatactttacaaaaatcaatagttatttctcgtattcaaagtaaacaagcagggggtgactttcgtcatccccccagactgtagacaaaacggttcgcgatatcatgtccgcgaaccgtttttttgcccatttccagttttcaaatctaaattttatgctggaaaaggaaaattgtaatgaagaagagcggtattttgctccccatttgatccgccatttccagattgccagtttctttagattcatgcagccaaacaagaggttcagctccatcttgattttagccagacctctgtactgggtatatctcatcccatgtttttcctttgcatctgcaaagactcgctctatggtttcttttcgctgtttatatctttctttcatcccggttgtatgacggatatcttcgacctgctccatgtagttttctcacacatgacgcgtaattacctttacgtcatccttactgtttgtgcagcggccccggtatggacagttttggcaaacaagccagtcacttttatactctcgatagccttcacggtttgttgtggtgtaatgaagcactcggtgattcggacacaaataacagtcaaagaattcatcatatacataatcatatttcttgaaataaccggctttgctcataggtcttttgtatggcatgactggaatttttccgtcttttatcagctgccgggcgatcgctggtatcttatatcccgcatccatcacgtaatacacgccatatttccagttctgctttaaacgtctgtataaaggccagaatgatacactgtcatgcacattccctgctgttacttcaaaatccaaaacataatgattcctgtcacaacaggtattggcagcataagcaaagacctgcttatgctcccctttatggaaccagccgctgtcaggatcggtggtactgaccttctgcgtcatcatttccggttctttttcctttttttcagcggcttctttccgtgttcctgacgatccctttcgatctcttcctgtagttctttttcatagctgcgtgcttctttacggatgacctcgtttcgatatttatgcgggttcgcgctggctttgatgtgagtgccgtcaatgaagaggctttctgtgtccagaaaaccattggcggcaacttcggaaagtatcttggcaaagattttttcaaacagatcggtatctttgaaacacctggaatagtttttaccaaaggtagagaaatgaggaatctcctcatgcattccatagcccagataccacctgtaagcgaaattcacttcgatctcacggattgttttacgcatggagggaattccgaaaatatattggatcatggcgatcttgatcaataccactggatcgatgctctcccgtccaaaatcgctgtataaatctttgacttcctcataaatgaaactcatatcgattgcttcgtccagcttccgcaccagatggtttctgggtacgagatcttccagacttgctatttccatttgtgttctttctgcgttatctttttccccatcataaagaaaacccgtaaccgtcaaataagacagtggcttccatttttataaaaatccatcataattaggtttagaacttttagagtttttggagcagctcctaaaactccaggaaacggaggcctgatcttatgaatgaattatccctaaaaacccagatgagcattcaaaaatggctggatatcatccatcgctgcagagaaagcggactttctaaccgccagtggtgccaagagaatgggatccaactgaaaagctattattactggctttccaaaatccgaaagctggcaattgaacagatcccaagaaaaacatccgctccaccgtcacttccgtccacggtatccagatctgcgtcgataacatttgctgaaatccctgttaagagaaactattctcgcgaggcagatcccatcacgatccatataggaaatgcctccatcgaaatccctacggatgctccggaccctcttatacagtccatcgtccggactgtttcccaatgttaggtgatatttcacgggccgaaaagatctatctggcctgtggatataccgatatgcgcaaggcgatcaatgggttagctgctatcgttcagcagaacttcaaactggatcctttttcaaacagcctgttccttttctgcggacgtaactgcagccgtctgaaagcattgtactgggaaggggatggttttgtcctgctttataaacgccttgagaatggccggttccaatggccccgctcacaggaagaggtgcggcagatctcggatcaggaattgcgctggcttctggaaggactatccatagaccagccaaaagcagtaaagaaactaaaaccaaaaagtgccctgtaggtgtcaatatcgcctgtatttactggagatcctgtcgcttttgtggtataatggaaacatgaaaaagcaaagggtgtaacaggttatgcaggctgaagatcaagttactgtattggaaaaacggatcagatcactggaaaaagaaaaccttctccttcaggaaaaggttgctttcctgactcgtaaactttacggaagatccacagaacagacatcgtctctcggtattgagggacagatgtctctttttgatgaagctgaaacttctgctgacgtatctgctgctgaaccggatctcaaagatgttgcgtcttaccgccgccggaaattcaaaggccagcgggaagattctttaaaagacattccgcacgaaaaaaagctatgcacccttgcagaagaagaccgtttttgtgaaaaatgcggaactcctctgatttctgtcggagaagaattcgtgcgtacagaaattgaattcattccggcaaaagtccgtgtgatcgattattaccgtgaaacttttgaatgcaggaaatgccgaaaagaaggaagagaatatatggaaaaatctccaatgccatatcctgtcatccagcattcctatgcgtccccgtcttcggtcgcctgggtcatccatcagaagtatgatcttgcggtgcctctttaccgccaggaaaaggaatgggcggagctgggagttgctttaagccgggcaaccatgtcgaactggatccttgccagttaccgtgactggctttctccggtagtcggactgctgaaggaaaagctgttggaacagaagtaccttcatatcgatgaaacgcctgtccaggtactcggagagcctggaagaagaaataccacggattcctacatgtgggtgtactgttctataaaaaacagtgggaagccgatccggatatttgattatcagcctggcaggagcgggatatttccccggaagttcctgaacggctataccggatatatccataccgatgcctataagggatatgaaaaggtgacggggattacccggtgcttctgctggacgcatctacgcagatattttgtagatgctcttccaaaagatgccaacagcccgcaggcaacgataccggcccaggcagtccgttatatcaaccgcctgtttgaactggaaaagaagctggaggtattatcaccggaaggaagaaaagcacagcgtctgatacaggaaaaacctgtattggaggctttctggtcatgggcagaaaatgcatctgccgggatcctgccaagatcgaagctgggggaagcctttacctatgcattcaatcaaagatccggcctgatgaattatcttttggacgggaactgctccatttcaaacaatctggcagagaacagcatccgtccattcacgatagggcgcaagaactggctgttttccggaagtcccaaaggagcaaaagccagtgcggggatctacacactgatagaaacagccaaggcaaatggattaaatccacgaaaatatatccagtatatccttggagacatcccgggttctgcgttcctgcagtatcccgaatacttggaggactaccttccatgggatccgatcattcaaaaactatgtcgataaccgttacctttcaagaatagcagaaaggcagcggtttttctatacaccgtcatacttgacggttacgaaaaacctgcctttcctgatgattctattataccatctggaaagcacaggtaaaactaaaaatagacaaccgcctccaaaaggaggtcgattgtctacagtctgaggagacttgaaagccaagtctcccgattataacttacttagaaatcatcactatattacgagttgtatgatggttatatattaatggataccctcttttaccagcatccattcctgacagccataatccgttatgccccattgtccgaccgatgcgccgtcttccgtagaattactgaatacttcaagatatttaccactatttttattcacaatatggcaatagccctcttccgtctcttctaataaccagatctgggaatcacgttccgcataactgctttgaattgcctttgccccatcaacagtactttcactttcaatatccagatacagtccactgttcatattcttgattctataactgccatttccggcatcttcaaaattccatttctggcaccaatgatcagtaattccccattgacctgattctgccccctcattcgtcaacgcactttttatctcaagatacttgccgctgtttttattaataatggcaaaatcattggaagtctcactgacttgtatacagtccagttctgcgaagccaacatctttactaaattttatcgaattagtgccggcatttaaataacaggaaaaaccactccaaaggtaacggtcccaattgactgtaacagggtaattaaccgttcctatctgtgttccgtttacggtaaccatgtgagatgcctctgttccctcaccattagaatacctgaccagaatattataatttccagagttttcgaccttgatgttctggaaatcaaccgagctgtctgactcattaatatactgcacttccagtccgttagatgcatcaacagcattaccagcctgagcatttgtaatcgctgctttttctgcttcgtaaatactccctttcagcggaagggtgccaacccttacatcattcaggttataacttactccatcaatagtcttggcattgctaaagttttctacatttgtagcctgatagagagtggaattatccgggctcacatcaaagctctggctaaatcctgaaaaatacccgcccgccaggtcattataatcataggtcaccgccattggcagccgctcccatgaacccctgccaagattgtagttcacataaaaattctgtccgccactgatactatcgctgctgtctgtcccccacttcgcagaaatcacaaccataccgttgggaccgcccgcatcaatccattttacatagggggaagaaccgattcccctgccgtccgccagagcaactctggttccaaggcttcctgcatcccatgtcacgccgtcatcggaaaacttgcagtagacaaccgcattattcttactcagactcgggcggttcaccatttcatacgttgccatatactttccgtttggcagctttgttaccgttatcatacccggtctatcgctcgtattatttattgccgcaacatttgtaagtccgctccaattcacgccgtcagatgaggttttaagagaaactgcctgcagaaccccatcggatttctgtctttcatcagaataatagcacactaaatctcccgatttgctcatccccaaaaacggctcccaaacagttgtggtagtagaagtagtactcggatcataaatacaagcgcccccattatctacctcacttagaaacgtccatgtgtatccgccatccatactcttataaaggactattctggactgagtataaggatcatcatcaaaaatattacctgcaagtaaaatggtaccggccggcatatccccaacctgaaccggcaattcatagagacatggctgggaagtccttaacagaccatattctttgtcatatacattactgataagctgccagttatccccattgtccgtgcttttataaatcggatatacctgttttgaaacactcgtaccatcatccatatcaaccgtaacatttttcagctggtcataggtacatagcaaagtgccattcgcgctaccactatttttcagacatatgattcttgaataagtagctcctccaggatcaaacgttgactcattgtcagaaacataaacagccactccattttctgttgtctttgcagacaccggaatcacgaaacaaaacaccatcataaacactgccacaagagcagtcagtctacggcacaaagtataccatcttcccatttttatatcctcctcgtatactggaatgtacatgtacaatgaataatcaaatataccctttggtcgattgactcctccattattcatgtataattaatcatgtctttgtactgtattttacaaagtctaggaaatcacagaactttaaaaattattctcaaaactaaacactggccgcccctctttatcccattcaatcctcatacggtacacatgcctgttaggatcatataacggatcaccatcaatctcatcatattgtctggcatgatagaccataatgtccccttttccatcctctgcttttgtaaatgaattgtgcccgggtccgagaatcccctttttccaatccgttttaacaacgggaactctttcctttttccatgcacgcggattcaacaattctccatcttccggaatgctcagcattcccatacaatagcattcacctgtagcacttgctgaatatgtcaggtataacataccatcatgccgcagtaatgccggaccttcatttacccaaaaatcaaccctctcccagtcgtaatccggagatgtcaaaagcacctggggggtagaaagctttgacggactttccatttctgctatataaagattcgatattttctttcctacactgaccttttctgcccacacacaataccatatccctctgttctgaaatacagtcatatcaagagagaaatctttgaatgaaaaatcatccgctgcctgcatctgccccaattccatccaggaatccttcaatggatcatctcctgtacacgctaaaacataagggcgtattgcccatatatcatccttattccccgccgcaaaataaataaaccatttatcttcaatacagtgaatttccggggcccatatatggatactcataattccctgtctatgcttctcccatatagtaacttcgtctgcatctgccagaccgtcaagcgttctgctgccgcgaagcacgatccggtcatattccggaacagaggcagtaaacaaatagcttccatccttttgcttatagacataaggatccgcccgttgaatgataaatggttcattatagtttgttttcataaaattatctatattcattataatttcctcacatttctaaaataaaggcaaatctattccgcatataataagctgctgcgtgctgatatatggtaaatcgccgattctttattttctgcccgctgtgaggttgtatacaaaatatattttcactgccagactacagagtttctctatctaatatcttataattcagataaatggctttcggtgaatactcttctgaatcgatctgagcaagcaattccgaaaccgcagttaccgccacaccctcaagatttgtagatactgttgttaatttgggagaaataaattccagaatattaatgttatcaaatcccattaacccataatcttttggtatagacatcccattctgctgtccccagcgcatcacattcaatgcatagctgtcgccggaacataaaaaggctgtccttttttctcttccttctttaatcacgcacttcacatcaggaagataatcagttttgccaatcaccgctgattcaagttcaggatatttagcaactgacgccctaaaccctagaagtctctgttcatggacatatatattttctttctctttcacagccagcggaggacagataaagacaactctttcatatcctttggacacgatcagatcgactgattccatagccgctgtcatctcatttacctgtactgtggttattgcatctgacacttgattccctatgcagacaatcgggatatgcagtgaacgcaaaaattcttcaaactcttttcctttattaatcggactgatcagtatcccttccatctgacggtccgcaagtccttgtatcagcttcttttcccaatccagactctcatcacagaccacaatattagtgaaataccctctcttgtctgcttccttatttataatatttaaagactggacaaaatacatattttctatattaatcgttaccacacccagggacattgttctgccatgattcaaacttctagccagcagattcggacgataattatattctttggcaactgccagaatcctttcccgtgtctccttcccaacgcttcccctgtcgtttaacgcccttaatacagttgttcttgatacaccgcatttttcagcaatttgatttacagtgattgccatctcccattccctccgttcacccataaaatccgtgccagccatgcctggacatatgatactctgcttaaaatcagcttaagtataacaccaatccacagccgccgcaacgaagagattgtctgagttcaaagtgcattatacggatgttactcagaatctgcgggaacgtacagtaacttatacatctatgcgaatcatattaaacgacagtggttcgatttctgcaatacaactgccagactcaatcactgcactttctcttgaacgcggtatgacagccttatgatcatattgattcgtcatctttttgtcttttgccgtcatacttacaaagcatttcaccctcttaagctcgaaattctggagtataacttctactttcattgaatgttcttcactcttattcactataaaaacagcaatttcattttcagcatcattccagacaacgacttcatcaagatatgggacatgtttaaaaccatcacattcataggctggtcccaacgcattgctcctcaaaactatgccatttgcataatttgcaaaataatagaatggataatagatggtctggagccatagcccgccgtttttctccgtcataatgcatgcactgacattagtaagaagtgactggcaggcaatctttataacatcggcatttcttaacattaccatctgcattcccgcaaaaagaagggcatcctccagtgtatatatttgttcactaattgcaggcgctatcttccagggttcttttgacacttccacattcacagaatcacttgggactgcccacaccccccattcatccatactaaatttaatatcttttccagagcgttttttcttcttaactacctgggcagcggagcgtaccgtttttatatattcctccatatcgagagtctgggctaaaaacgcctttgtacctttttcctgtcccccatagtactggtgcagggccagataatcaatcacatcgtatgtctgttccaggacctccatatcccacattggatatgtctccatatttgacagggaactgccgcatgcaatcaactctatcgacgggtctaccagcttcatagtctttccggcttctgcagcgaggcacccatattcatatgcactcttatgccctatctgccacacgccgtccatttcatttccaaggcaccacatcttcactccataaggcttttgtacaccgtggttttttcgcaattcactgtactccgtccccccggggaagttgcagtactcaatgtattggactgcctcttctattcccctggttcccagatttaccgtaaagattggctcaacacctgcttttcgcgcccaatggataaactcatttgtcccaaactcattcgtttctatcgccttccacgcaagttcaagcttccttggcctgctctccctcgggccaacaccatcttcccaacggtaagcagagacaaagttccctcccgggtagcggacagatgtcactcccatttctcttaccttttccagcacgtcgccgcgaaatccttcgtcatcagaacttaaattttccggttcgtacacccctgtataaataactcttcccatatgttccagaaatgaaccataaagcctagggtcaatgttccctattttaaaatttttatcgcaaacaattttagcctctaacatacaaatctccttaaccctttaatccggcgcttgccataccttccacaaaatatttctgtccggccatatacaggataaacatagggagcagtgagatcagtgctcctgcaaatgccgccccatactcaattgtattctgtcctatgaataatgccagaccatttgccagtgtccgcatttgtgtcttgctcgtcacaatcatcggccacagcaaatcattccatgatccattgatacttaatataatcagcgtaatcgctgctggtttcacctgcggcatcatgatccgccagaaaattcccatttctgaaagtccatcaatcctggcagcctcggccagctctttcggtattcctgagaaggccgcccgcatcataaagatagagccggcaaccgcaactcttggtataatcagcccccagtatgaatcatacattcccaacttaaatacaacgaggaataatggaaccataataacctgaaaggggaccatcattgtagctaaagtcattaagaacagtcctgtctttcctttgaagtcataaaaagcgtatgcataaccggccatactattcacaatgacagccagcaatgtcgtgccgcctgcatagatcacagagttaagcatatagcgcagtatattaatacgatcctgtacatcaacaaaattttctacagtaagtgactgtggtacaaatgtaggaggccaggatattatttctttttccggcttaaatgcacttaacgtcatccagataatcggcaccagaaccagcagagccagaatgactaaaacgataaatatgggaatactgatcgttacatctttgatcttgattgcctttttctttttcataataatctccattccgccgccaagtcggcggcacaaatagtaatgaaagtattccaacttctactctttggtgtaaaatagcttgtgagaagctacactacaaagcacgggaggagaagttgtaataactttcttcgttttagacagcataataatcagtgtaagttctgccttttcaagcacaaataagtggtactatgagtccgcacactaagaattgtttaagcgccttagtttaattgtgtggcagttcagtcaatggcctctcttcttttacgaaaggagtctgacttatgaaagttgtttatcaaacctgttgtggtgtcgatgttcacaaatcttttctcgttgccacaatcattaaaaccacttccggtgtggaaccttcgtatcaaaagaagcgtttctccacctttaacaattctattcttgaattcaagcactggcttctcgacaataactgccgggatgtctgtatggaatccaccggtaaatattggatccctgtctttaaccttttagaagacgaaataaacgtcaccatcgctaaccctaaatgggtaaaagctgtcaaaggcaataaagatgatacgaaagattccaaatggattggggacttgttccgtcttggacttgtgagaggcagttatgttccttgtaagaccatccgtattttacgtgaatatactcggtatcgctacaaacttgtttcctgccgtaccagtgaaaagaacagatatcagaatgcgctcactgtctgtaatgtcgcattagattcagtagtttccgatatcttcgggaagtcatccacatccattattgactacctgcttgaacagtccggtcactctattaaccacgaagaaatcgcatcaaaacttcttagacgtctcaaatctaaaacagatgccgttatagaatccatcgagggatatcagatgactgatgcccaaaaataccgtatgcgcctcgtccgcgcacatatggattatatcacagccgaaatcactgatatagactctatgatagaaaatctgatttcttctgatcctgattatgaaaatactgttcagttactctgtaccattccgggtgtaaaacatgacagtgcaatcactatcatctccgaaatcggtattgatatgactcagttctgtacctcaaagcgtttatgctgctgggccggattaactccggggagcaacgaatctgggggtaagaagaaatctgttcgcattactcgtgctggtgtctacctcaaacctgcattagtacaatgcgctcatgcggccgtgaaatccgaccaatctccttactacaaaaagaaatatgaatctcttgtaaaacgtcgtggtaaaaaacgtgccattattgctatcgcccggatgattctcactgctatctatcagatgttatctactggggaaacatggaatccgaccgatttatttaaaattgatatgcctgaggttttgcttgaaaagcaaaaacaaaaggctatcaaacaagcgcagaagttactgatacgcgaagggttattacctccattggaacccctggcttcctaaactaattatctgatctatacttttttacaggttaccatttctggtagcttattaaagtacgtcactttttggctatcctctactttctttcacactaatcctcctgattcattttgtggtacatcagcacagttacaaccataattatcgcaaataaaatcacggacatggcagaagcgtatcccatacttgaacgcgatgagaatgctctggaataaatataagtgaccgtagattcggttgtatagttaggcccgccatttgtcgtaatatatataatatcaaatatctgcagtgcccctgcaaaccgtgtcattaaaatgtaccagaaggttggcctgatggatggcgctgtaatatgccagaactgccttatcttccctgccccgtccatctcagccgcttcatataaggaagctgatacctgctggattgccgtcacataaataattgcagaaatcccgaagcttctccatatagatatgaacgaaactacaaatatagtaaggcccggtgtattaagaaaattaatcttcccaagccccatagattgtaatgctgctgtaacaaagccaatattggagtgcagaatcatcttccacataataccaatagccgtcgcagaacatatcacaggcagaaaataaaccgctctgaaaatcttgttcttgatattattcttagcaatcagcgccgcaactaccagtgctcccagaacctgcagtggtacctccaggccagtgaaaatagccgtcacttttaagctgtttataaaccgactgtcctgaaatgcctcagcaaaattttcaaggccgataaagcgcgccgaatccattgtaatagatacatcgaataagcttaatccgaatgcaataataagaggcactacactaaacagaatcaacaaaatgaccgatggggccaaaaagagataagcacttctggaaggcttattccagtattttatcattttcttcattatcacttctcctacctgcctcaagttcccagtgaaaggcggctggttcagccgcctatttgctgccatccgcagacaacaacaccattaaatcaattatttattatattcctcaactattttatctgctgtattctgagctttttcaagtgcatcctccaccgatgcattaccaaatgctaccgagttaatcatttccggaataacatcgtttaaaatatcattaatacccgggaaacttgaatcaacaataaaatccgttggcgcatccggatttgcagaagacatcacactaagcttttcactttgtttgtattcctctttttcctgaacggaatatgtataggctgggaaaccatttgacacagaccactctaaagctgggctggagccttctgtattttctgaattccaccactcaatgaacttatatgcagcttctttttcctcatcacttgccgttgttgtaacagagaaaccaagaacctctactgaattcatgtctcctgcatctccctgaggtatcaggccaattccataattaacacctgccgtatcaagccccgctgttacccacggcccgccgactgtcataccaatctgccctgcacttaccatagaatctgtatcagcttccagcgggttatctccgttgtcgattagtgtcttgtacatcgtaagaaaatcagtgtatccagtgtttcctgcgaaatctgccttccagctgccattatcatcttttactgccaaaccgcctaagcgctgcatcatatgtgcaatctgatatggataatcataagaaataccagagccataaatattcttgccctcatccgtaatcttttcagcatatgactgccactcttcccatgttgaaggaggtgtctccggattaagtcccgccgcttggaataaatccttgttccaatacatgtaataacctacaacctgaaatggaacaaagtacaacttatccccctcagagcaatagtcgagatatgattgtatgaaatcatccttatttagattagtcttatcaaacacatcgccgatatcctgcatatagtccccgtaagtaaacctatatgcacttgaacttaaaatcatggtagggcctgttcctgccgcaaaggcagtggatagctggctgtcaaaatctgaagatatatccatctcaacagtgattccatctttgttctcttcattataccggtttactaattcaaccagcatatcgccatctgagcctgtaaaactattccagaatgatattgtcgtacctttggtgcttttctttacatccccatcatctgtttttgacccctccttggaatcgcttccacaagctaccgttgagaaaatcatcattgctgaaactccaagcgcagctaatctcttccacttgttcacttttttcataattatttctccttttcttcaactttttagcaaacatactttaccggtttgtcgtatgtcggctttttgcagcgattgtacacgtgtaacccgcttttataaattaagaatattatttttgtgcataaatgtcaataaaaatttataataccggcattttgcatcattttttcacataacttttgttaaatattgcatgttattctagtaattatcagatttatttttatatttttttatattaaccaaatgttcacgggtacattctgccccccacacaccatatttcatgaggtatataaaaaaagagttcccggcaagcctacacactcaccaggaaccctccgcaaactgttctattcaaatattaccgccacactgatactcaactccgacactgcattcgagacccgcattgttccaatccctgacacccttaaatcccatacgtgaactggccactccataagctttactatagggttattttatctcatttaccggcggaaggcatatatgatccttacaaacataatatgttgtatttccgttcagcaatttaaactccggcgtttcttcctttaagatctttatatctgcatacagcggaacgcggctgatgatttcttcctctgtgtccgttttcgataatatagccgtaatcttttgaggaggatagttatatagcagaagcgcagtcagaaacatacagtatcccgccggatagccctccgctagatgggacatatatgcaagctgctgctctgctgcaattttataatctttattatctgtaatctgaaaaagccgtacaagacaataagccatcacggaatttccactgggtattgcaccatcataggtttcttttggcctcgtaatcaatctgtcattccggtctccgtacagaaaaaaacctcctccattctgatcctcaaactgccgtcgtgcttcattacagatctcttctgcacgccttaggtacttttcatcagagacagcctcgtaaagacttagcaatgccgctgtataatatgcatattcatcaagaaatccgtttacagtcccagctccattgcggcagctgacaaaaagtatatttctgtctgccaagtttttctcaatgaaacaatgcgcctgcacggccgattgaagatatcgttcctttccggtgacccggtatagtaccaccatagcagaaagcatcaaagaattccatgtggtaaggactttatcatccagatggagttttgttcttaactgccgattttcatataaaagctttttttctttatggaatttatcagaaataggatttctattcaacaggtttggtatatttttcccctcgaagtttcccctttcagaaattccgaaataactgcagaattcctcccctttttttctaccaagtatattacaaatttcttcataatcccagatataatataatccttccctgccctcactatccgcatcctgagcagagtaaaattcaccgtcagatcctgtcatttcccgcaaaatatactccgcagttttttctgctgtatctagaaacatgttttcttcagatatcttaaatgcagctgcgtatgcaattatgagcagtgcattatcatataacattttttcaaaatgaggaacgagataaaaacggtctgtggaatatctggaaaatccatatccaatatgatcaaaaatcccccctcttcgcatttgctccaaagttttttccacctgataccatttatcaccaagcccaatcccggaatacagcataagaaatattagattatggggtgttgggaatttaggtgctgaaccgaacccaccgtagtttttatcaaaggaccttgtaaataattctgctgcctgcccagggagtccgctgtctattgcttttccagcccgcttttgcactttatcttctgaattgcccacatttgtatctatttgactaaaaatctgttctgccgactgcagcaaaccggctctcttttgtttccaaagtttattgatctccagtaacagttcccgaaatcccatcataccagaacggtttacaggcggaaaatacgttcctgcgtagaagggtttctgctctgctgtcataaaaatactcataggccatcctccactccctgtcagtgtctggcagacagccatatacacactatctatatcgggacgctcttccctgtctactttaatggaaataaaattttggtttagaatggcggcaatttcctcattttcaaaactctcatgtgccatcacatgacaccagtgacaggtgctgtagccaatacttaaaaaaacgggtttatcttcctgccttgctctttcaaatgcctcattacaccatggataccagtcgacaggattttctgaatgttgtataagatatggactgctttgacctcttagatggttactactcataacggtcctccttttagatgttccttaaaagcatttccactatgcgtgcaaacaataccttacgatccaatcccttttggcatcaatgactgcctgtacacattgtccggttcctaattggaaactgccgcttgattatagaccctagttatacttttgttgagctttgatttcatcataaatatcaatactatcctggaatctagcatcctcagtagaccccatcactacacagatgtatgtttctccgttaataactgccgcagatactaggcaagcaccggccagactgctgttacccgtctttagaccgatcacctcagggcgataccattggctgcttggattaagaagttcatttgtattattgaaagtaaccactctcccattcgcccatctttcggatgatgtataacttgccacaatttgcgaaatgatgggattatccaaacatgcttttgcaataagggcaagatcataggccgtagtatactgaccatcgacgtcatatccatctggcactacaaaatttgaattctcagccccaagcatctgggacttttcatttaccttatccatgaacacatgaatggattgcttattcgtcaggccgttatcttctgcaattttctttccggtattcacagcaagcgtatacgccgcgtcattgccggaaggaagcataagggcaattaagagctgtctgactgtcagggtatcgcccttagtcagccacgctcttgatgaatccccgtgaatcattctaatttctgcacctacagtcagttcatcattcggtgaaaagtagtcaagcactgtaaatgccgtaatcatcttagcagtactggcgggtgcaattctatgggtaccgtttttctgatatagtacagtgtttgtagctgcacccattacaatggcattttgggctgaaatatccactgaaatagagttatctgcgtcgagaattgatgaaaccgtccagctctctccgccgtccatttgtgaaaactctccattgtttatcatactttctttaccagtgaatggagaccctttgctgacacctaatagatttcctcctccaaagactgcaactgttatgattatacgtaaccgtcaagtatgacggtgtatagaaaaaccgctgcctttctgctattcttgaaaggtaacggttatcgacatagtttttgaatgatcggatcccatggaaggtagtcctccaagtattcgggatactgcaggaacgcagaacccgggatgtctccaaggatatactggatatattttcgtggatttaatccatttgccttggctgtttctatcagtgtgtagatccccgcactggcttttgctcctttgggacttccggaaaacagccagttcttgcgccctatcgtgaatggacggatgctgttctctgccagattgtttgaaatggagcagttcccgtccaaaagataattcatcaggccggatctttgattgaatgcataggtaaaggcttcccccagcttcgatcttggcaggatcccggcagatgcattttctgcccatgaccagaaagcctccaatacaggtttttcctgtatcagacgctgtgcttttcttccttccggtgataatacctccagcttcttttccagttcaaacaggcggttgatataacggactgcctgggccggtatcgttgcctgcgggctgttggcatcttttggaagagcatctacaaaatatctgcgtagatgcgtccagcagaagcaccgggtaatccccgtcaccttttcatatcccttataggcatcggtatggatatatccggtatagccgttcaggaacttccggggaaatatcccgctcctgccaggctgataatcaaatatccggatcggcttcccactgttttttatagaacagtacacccacatgtaggaatccgtggtatttcttcttccaggctctccgagtacctggacaggcgtttcatcgatatgaaggtacttctgttccaacagcttttccttcagcagtccgactaccggagaaagccagtcacggtaactggcaaggatccagttcgacatggttgcccggcttaaagcaactcccagctccgcccattccttttcctggcggtaaagaggcaccgcaagatcatacttctgatggatgacccaggcgaccgaagacggggacgcataggaatgctggatggcaggatatggcattggagatttttccatatattctcttccttcttttcggcatttcctgcattcaaaagtttcacggtaataatcgatcacacggacttttgccggaatgaattcaatttctgtacgcacgaattcttctccgacagaaatcagaggagttccgcatttttcacaaaaacggtcttcttctgcaagggtgcatagctttttttcgtgcggaatgtcttttaaagaatcttcccgctggcctttgaatttccggcggcggtaaggcgcaacatctttgagatccggttcagcagcagatacgtcagcagaagtttcagcttcatcaaaaagagacatctgtccctcaataccgagagacgatgtctgttctgtggatcttccgtaaagtttacgagtcaggaaagcaaccttttcctgaaggagaaggttttctttttccagtgatctgatccgtttttccaatacagtaacttgatcttcagcctgcataacctgttacaccctttgctttttcatgtttccattataccacaaaagcgacaggatctccagtaaatacaggcgatattgacacctacagggcactttttggttttagtttctttactgcttttggctggtctatggatagtccttccagaagccagcgcaattcctgatccgagatctgccgcacctcttcctgtgagcggggccattggaaccggccattctcaaggcgtttataaagcaggacaaaaccatccccttcccagtacaatgctttcagacggctgcagttacgtccgcagaaaaggaacaggctgtttgaaaaaggatccagtttgaagttctgctgaacgatagcagctaacccattgatcgccttgcgcatatcggtatatccacaggccagatagatcctttcggcccgtgaaatatcacctaacattgggaaacagtccggacgatggactgtataagagggtccggagcatccgtagggatttcgatggaggcatttcctatatggatcgtgatgggatctgcctcgcgagaatagtttctcttaacagggatttcagcaaatgttatcgacgcagatctggataccgtggacggaagtgacggtggagcggatgtttttcttgggatctgttcaattgccagctttcggattttggaaagccagtaataatagcttttcagttggatcccattctcttggcaccactggcggttagaaagtccgctttctctgcagcgatggatgatatccagccatttttgaatgctcatctgggtttttagggataattcattcataagatcaggcctccgtttcctggagttttaggagctgctccaaagactctaaaagttctaaacctaattatgatggatttttataaaaatggaagccactgtcttatttgacggttactcccattggtttcggtaggtgcatcttattaacattaaaaaagaccaaaacaaaatgttttagcctttatataaactgccggtgaccggacttgaaccggtacgggattgctcccgaaggattttaagtcctttgcgtctgcctattccgccacaccggcatatatgaaacacccaactgacaccctggaatttgaagggatgttttggagggatgtaagcatatctaccctatattaaattgtgaaaccactgattttgcgtgattttacgcctaaaatgtggaactgacctacaggactttaagtcccgggcgtctgccagttccgccactgcggcaaaacgacccggatgggaatcgaacccacgacctccgccgtgacagggcggcgctctaaccagctgagccaccgggccaaatctaactgtatacaaatggaccctcggggactcgaaccccggaccgatcggttatgagccgattgctctaaccaactgagctaaaggtccaaagagccgttgaccggacttgaaccggtaacctgctgattacaaatcagctgctctgccaattgagccacaacggcgaacctgtttaacctattgtttcactctatccttcaccaagtatggtgaggcttccttacttatgttcttgagtgactccaacgggatttgaacccgtgttaccgccgtgaaagggcggtgtcttaaccacttgaccatggagccaaaaaactccccctg
